US008541387B2

(12) United States Patent
Pandey et al.

(10) Patent No.: US 8,541,387 B2
(45) Date of Patent: Sep. 24, 2013

(54) MODULATION OF SMRT EXPRESSION

(75) Inventors: Sanjay K. Pandey, Encinitas, CA (US); Sanjay Bhanot, Carlsbad, CA (US); Eric G. Marcusson, San Francisco, CA (US); Susan M. Freier, San Diego, CA (US)

(73) Assignee: Isis Pharmaceuticals, Inc., Carlsbad, CA (US)

(*) Notice: Subject to any disclaimer, the term of this patent is extended or adjusted under 35 U.S.C. 154(b) by 163 days.

(21) Appl. No.: 12/993,249

(22) PCT Filed: May 21, 2009

(86) PCT No.: PCT/US2009/044916
§ 371 (c)(1),
(2), (4) Date: Feb. 4, 2011

(87) PCT Pub. No.: WO2009/143387
PCT Pub. Date: Nov. 26, 2009

(65) Prior Publication Data
US 2011/0152351 A1 Jun. 23, 2011

Related U.S. Application Data

(60) Provisional application No. 61/128,621, filed on May 22, 2008.

(51) Int. Cl.
*C12N 15/11* (2006.01)
*A61K 48/00* (2006.01)
*C07H 21/02* (2006.01)
*C07H 21/04* (2006.01)

(52) U.S. Cl.
USPC ........................................ 514/44 A; 536/24.5

(58) Field of Classification Search
USPC .................. 536/24.1, 24.5; 514/44
See application file for complete search history.

(56) References Cited

U.S. PATENT DOCUMENTS

| | | | |
|---|---|---|---|
| 5,801,154 | A | 9/1998 | Baracchini et al. |
| 6,582,908 | B2 | 6/2003 | Fodor et al. |
| 7,205,146 | B1 | 4/2007 | Keith et al. |
| 7,399,845 | B2 | 7/2008 | Seth et al. |
| 7,427,672 | B2 | 9/2008 | Imanishi et al. |
| 2001/0053519 | A1 | 12/2001 | Fodor et al. |
| 2003/0228597 | A1 | 12/2003 | Cowsert et al. |
| 2004/0005292 | A1 | 1/2004 | Bennett et al. |
| 2004/0171570 | A1 | 9/2004 | Allerson et al. |

FOREIGN PATENT DOCUMENTS

| | | |
|---|---|---|
| WO | WO 99/14226 | 3/1999 |
| WO | WO 03/004602 | 1/2003 |

OTHER PUBLICATIONS

Allen et al., "Halofenate is a Selective Peroxisome Proliferator-Activated Receptor Modulator with Antidiabetic Activity" Diabetes (2006) 55:2523-2533.

Altschul et al., "Basic Local Alignment Search Tool" J. Mol. Biol. (1990) 215:403-410.
Berghagen et al., "Corepressor SMRT Functions as a Coactivator for Thyroid Hormone Receptor T3Ralpha from a Negative Hormone Response Element" The Journal of Biological Chemistry (2002) 277(51):49517-49522.
Branch et al., "A good antisense molecule is hard to find," TBIS (1998) 23:45-50.
Chen et al., "Evidence That the Diabetes Gene Encodes the Leptin Receptor: Identification of a Mutation in the Leptin Receptor Gene in db/db Mice" Cell (1996) 84:491-495.
Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.
Choi et al., "The functional relationship between co-repressor N-CoR and SMRT in mediating transcriptional repression by thyroid hormone receptor alpha" Biochem. J. (2008) 411(1):19-26.
Chua et al., "Phenotypes of Mouse diabetes and Rat fatty Due to Mutations in the OB (Leptin) Receptor" Science (1996) 271:994-996.
Cohen, "Nuclear receptor corepressors and PPARγ" Nucl. Recept. Signal. (2006) 4:e003.
Crooke et al., "Basic Principles of Antisense Therapeutics" Antisense Research and Application (1998) Chapter 1:1-50.
Gautschi et al., "Activity of a Novel bcl-2/bcl-xL-Bispecific Antisense Oligonucleotide Against Tumors of Diverse Histologic Origins" J. Natl. Cancer Inst. (2001) 93:463-471.
Higgins et al., "Vascular Endothelial Growth Factor Receptor-2 Expression Is Down-Regulated by 17beta-Estradiol in MCF-7 Breast Cancer Cells by Estrogen Receptor alpha/Sp Proteins" Molecular Endocrinology (2008) 22(2):388-402.
Hu et al., "Liver X Receptors Interact with Corepressors to Regulate Gene Expression" Molecular Endocrinology (2003) 17(6):1019-1026.
Ishizuka et al., "The N-CoR/Histone Deacetylase 3 Complex Is Required for Repression by Thyroid Hormone Receptor" Molecular and Cellular Biology (2003) 23(15):5122-5131.
Jepsen et al., "Cooperative regulation in devleopment by SMRT and FOXP1" Genes Dev. (2008) 22(6):740-745.
Jepsen et al., "SMRT-mediated repression of an H3K27 demethylase in progression from neural stem cell to neuron" Nature (2007) 450:415-420.
Jones et al., "RNA Quantitation by Fluorescence-Based Solution Assay: RiboGreen Reagent Characterization" Analytical Biochemistry (1998) 265:368-374.
Karagianni et al., "HDAC3: taking the SMRT-N-CoRrect road to repression" Oncogene (2007) 26(37):5439-5449.
Ki et al., "Glucocorticoid Receptor (GR)-Associated SMRT Binding to C/EBPbeta TAD and Nrf2 Neh4/5: Role of SMRT Recruited to GR and GSTA2 Gene Repression" Molecular and Cellular Biology (2005) 25:4150-4165.
Lazar, "Nuclear receptor corepressors" Nucl. Recept. Signal. (2003) 1:e001.
Maher et al., "Comparative hybrid arrest by tandem antisense oligodeoxyribonucleotides or oligodeoxy-ribonucleoside methylphosphonates in a cell-free system" Nuc. Acid. Res. (1988) 16:3341-3358.

(Continued)

*Primary Examiner* — Terra Cotta Gibbs
(74) *Attorney, Agent, or Firm* — Knobbe Martens

(57) ABSTRACT

Disclosed herein are compounds and methods for decreasing SMRT and treating metabolic and/or cardiovascular diseases in an individual in need thereof. Examples of disease conditions that can be ameliorated with the administration of antisense compounds targeted to SMRT include obesity, diabetes, dyslipidemia, and hypothyroidism.

37 Claims, No Drawings

(56) References Cited

OTHER PUBLICATIONS

New England Biolabs 1998/99 Catalog (cover page and pp. 121 and 284).

Pandey et al., "Novel role of Suppression of Nuclear Receptor corepressor, SMRT (Silencing Mediator of Retinoic Acid and Thyroid Hormone Receptor) in Regulating Lipid Metabolism in Mice" Abstract No. 1936-P, American Diabetes Association, Scientific Sessions 2008, Category: Signal Transduction (Not Insulin Action) Transcriptional Regulation.

Peterson et al., "The Silencing Mediator of Retinoic Acid and Thyroid Hormone Receptor (SMRT) Corepressor Is Required for Full Estrogen Receptor alpha Transcriptional Activity" Molecular and Cellular Biology (2007) 27(17): 5933-5948.

Picard et al., "Sirt1 promotes fat mobilization in white adipocytes by repressing PPAR-γ" Nature (2004) 429:771-776.

Reynolds et al., "Rational siRNA design for RNA interference" Nature Biotechnology (2004) 22(3):326-330.

Sanghvi et al., "Heterocyclic Base Modifications in Nucleic Acids and Their Applications in Antisense Oligonucleotides" Antisense Research and Applications (1993) pp. 273-288.

Takahashi et al., "The Flt3 internal tandem duplication mutant inhibits the function of transcriptional repressors by blocking interactions with SMRT" Blood (2004) 103:4650-4658.

Ting et al., "Increased Expression of Corepressors in Aggressive Androgen-Independent Prostate Cancer Cells Results in Loss of 1alpha, 25-Dihydroxyvitamin D3 Responsiveness" Mol. Cancer Res. (2007) 5(9):967-980.

Van Der Laan et al., "Nuclear receptor coregulators differentially modulate inductiona nd glucocorticoid receptor-medaited repression of the corticotropin-releasing hormone gene" Endocrinology (2008) 149(2):725-732.

Velliquette et al., "Therapeutic Actions of an Insulin Receptor Activator and a Novel Peroxisome Proliferator-Activated Receptor Gamma Agonist in the Spontaneously Hypertensive Obese Rat Model of Metabolic Syndrome X" The Journal of Pharmacology and Experimental Therapeutics (2005) 314(1):422-430.

Wagner et al., "Promoter-Specific Roles for Liver X Receptor/Corepressor Complexes in the Regulation of ABCA1 and SREBP1 Gene Expression" Molecular and Cellular Biology (2003) 23(16):5780-5789.

Woolf et al., "Specificity of antisense oligonucleotie in vivo" PNAS (1992) 89:7305-7309.

Yoon et al., "The Corepressors Silencing Mediator of Retinoid and Thyroid Hormone Receptor and Nuclear Receptor Corepressor Are Involved in Agonist- and Antagonist-Regulated Transcription by Androgen Receptor" Molecular Endocrinolog (2006) 20(5):1048-1060.

Yu et al., "Improvements in both adiposity and Hypercholesterolemia after Antisense Reduction of Silencing Mediator of Retinoic acid and Thyroid Hormone Receptor (SMRT) Expression in Diet-Induced Obese Mice" Obesity (2008) Volulme 16, Supplement 1, Abstract No. 55-OR, p. S62.

Zhang et al., "PowerBLAST: A New Network BLAST Application for Interactive or Automated Sequence Analysis and Annotation" Genome Res. (1997) 7:649-656.

International Search Report for application PCT/US09/44916 dated Sep. 2, 2009.

MODULATION OF SMRT EXPRESSION

CROSS-REFERENCE TO RELATED APPLICATIONS

This application is a 371 National Stage of International Application No. PCT/US2009/044916, filed on May 21, 2009, which claims benefit under 35 USC 119(e) to U.S. Provisional Application No. 61/128,621, filed May 22, 2008, which are incorporated herein by reference.

SEQUENCE LISTING

The present application is being filed along with a Sequence Listing in electronic format. The Sequence Listing is provided as a file entitled BIOL0102WOSEQ.txt, created on May 21, 2009, which is 772 Kb in size. The information in the electronic format of the sequence listing is incorporated herein by reference in its entirety.

FIELD OF THE INVENTION

The present invention provides compounds and methods for decreasing SMRT expression and treating metabolic and/or cardiovascular diseases in an individual in need thereof. Such methods and compositions are useful to treat disease conditions such as obesity, diabetes, dyslipidemia, and hypothyroidism.

BACKGROUND OF THE INVENTION

Metabolic diseases are a group of conditions characterized by an alteration or disturbance in metabolic function. Metabolic diseases include, but are not limited to, obesity, hyperglycemia, prediabetes, diabetes (Type 1 and Type 2), insulin resistance, and metabolic syndrome.

Obesity is defined as the accumulation of excess adipose tissue resulting from various metabolic disorders. Obesity and the related metabolic syndrome have become a worldwide epidemic. Metabolic syndrome refers to a clustering of established and emerging cardiovascular disease (CVD) risk factors within a single individual. The established risk factors are obesity, diabetes, dyslipidemia, and hypertension. The symptoms of this syndrome include high blood pressure, high triglycerides, and decreased HDL. Insulin resistance is also an important factor in this syndrome's etiology.

Type 2 diabetes mellitus (T2DM) is a disease that is exacerbated by over nutrition. The onset and progression of T2DM is associated with excess fat accumulation in the abdomen, muscles, and liver. Resistance to the biological effects of insulin, a peptide hormone, represents one of the hallmarks of the development of type 2 diabetes. There is a direct effect of impaired insulin action on the dysregulation of glucose and lipid homeostasis, and insulin resistance predisposes to obesity, atherosclerosis, and cardiovascular diseases. Diabetes and obesity are therefore closely interlinked and are often referred collectively as diabesity.

Nuclear receptors (NRs) comprise a superfamily of ligand-regulated, DNA-binding transcription factors, which can both activate and repress gene expression. Nuclear receptors play an important role in metabolism. The peroxisome proliferator-activated receptors (PPARs) are the master regulators of adipogenesis and insulin action. The thyroid hormone receptors (TRs) mediate cholesterol and triglyceride metabolism. The liver X receptors (LXRs) are critical for whole body cholesterol homeostasis and are counteracted by the farnesoid X receptors (FXRs) in terms of controlling cholesterol and triglyceride metabolism and clearance. All these nuclear receptors use overlapping coregulators to modulate gene transcription.

SMRT is a major corepressor of nuclear receptors and can regulate a broad range of their functions. SMRT mediates transcriptional activity of a wide variety of transcriptional factors including regulators involved in thyroid hormone and retinoic acid signaling. Corepressors, including SMRT, are generally considered undruggable. Small molecules previously designed to target SMRT lack specificity resulting in undesirable side affects.

SUMMARY OF THE INVENTION

Provided herein are methods, agents, and compositions for modulating SMRT. The agents and compositions include SMRT-specific modulators. SMRT-specific modulators include nucleic acids, peptides, antibodies, and/or histone deacetylases. Any of the listed SMRT-specific modulators can be SMRT-specific inhibitors.

Also provided are methods of treating diseases and disorders. Included are methods of treating cardiovascular and metabolic diseases and disorders. The diseases and disorders include, but are not limited to, those associated with lipid dysregulation, fat dysregulation, adipocyte dysregulation, and glucose dysregulation.

Also provided are methods of treating multiple disease or disorders. The multiple diseases or disorders can include any of the diseases and disorders provided herein. The multiple diseases and disorders can have one or more risk factors, causes, or outcomes in common.

The present invention is also directed to methods of reducing risk factors associated with disease and causes of disease. Such diseases include cardiovascular and metabolic diseases such as, but not limited to, diabetes, metabolic syndrome, and atherosclerosis. Risk factors include, but are not limited to, lipid level, adiposity, glucose level, and insulin responsiveness.

In certain embodiments, methods of treatment include administering to a subject a SMRT-specific modulator. In certain embodiments, a SMRT-specific inhibitor is administered.

Methods of modulating SMRT include methods of modulating levels of SMRT. The levels can include but are not limited to SMRT mRNA levels and SMRT protein levels. Modulation can occur in a cell or tissue. In certain embodiments, the cell or tissue is in an animal. In certain embodiments, the animal is a human. In certain embodiments, SMRT levels are reduced. Such reduction can occur in a time-dependent manner or in a dose-dependent manner or both.

DETAILED DESCRIPTION OF THE INVENTION

It is to be understood that both the foregoing general description and the following detailed description are exemplary and explanatory only and are not restrictive of the invention, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated by reference in their entirety for any purpose.

Definitions

Unless specific definitions are provided, the nomenclature utilized in connection with, and the procedures and techniques of, analytical chemistry, synthetic organic chemistry, and medicinal and pharmaceutical chemistry described herein are those well known and commonly used in the art. Standard techniques may be used for chemical synthesis, and chemical analysis. Where permitted, all patents, applications, published applications and other publications, GENBANK Accession Numbers and associated sequence information obtainable through databases such as National Center for Biotechnology Information (NCBI) and other data referred to throughout in the disclosure herein are incorporated by reference in their entirety.

Unless otherwise indicated, the following terms have the following meanings:

"2'-O-methoxyethyl" (also 2'-MOE and 2'-O(CH$_2$)$_2$—OCH$_3$) refers to an O-methoxy-ethyl modification of the 2' position of a furosyl ring. A 2'-O-methoxyethyl modified sugar is a modified sugar.

"2'-O-methoxyethyl nucleotide" means a nucleotide comprising a 2'-O-methoxyethyl modified sugar moiety.

"5-methylcytosine" means a cytosine modified with a methyl group attached to the 5' position. A 5-methylcytosine is a modified nucleobase.

"Acceptable safety profile" means a pattern of side effects that is within clinically acceptable limits.

"Active pharmaceutical ingredient" means the substance or substances in a pharmaceutical composition that provides a desired effect.

"Active target region" means a target region to which one or more active antisense compounds is targeted. "Active antisense compounds" means antisense compounds that reduce target nucleic acid levels.

"Adipogenesis" means the development of fat cells from preadipocytes. "Lipogenesis" means the production or formation of fat, either fatty degeneration or fatty infiltration.

"Adiposity" or "Obesity" refers to the state of being obese or an excessively high amount of body fat or adipose tissue in relation to lean body mass. The amount of body fat includes concern for both the distribution of fat throughout the body and the size of the adipose tissue deposits. Body fat distribution can be estimated by skin-fold measures, waist-to-hip circumference ratios, or techniques such as ultrasound, computed tomography, or magnetic resonance imaging. According to the Center for Disease Control and Prevention, individuals with a body mass index (BMI) of 30 or more are considered obese. The term "Obesity" as used herein includes conditions where there is an increase in body fat beyond the physical requirement as a result of excess accumulation of adipose tissue in the body. The term "obesity" includes, but is not limited to, the following conditions: adult-onset obesity; alimentary obesity; endogenous or metabolic obesity; endocrine obesity; familial obesity; hyperinsulinar obesity; hyperplastic-hypertrophic obesity; hypogonadal obesity; hypothyroid obesity; lifelong obesity; morbid obesity and exogenous obesity.

"Administered concomitantly" refers to the co-administration of two agents in any manner in which the pharmacological effects of both are manifest in the patient within the same time or during the same time period. Concomitant administration does not require that both agents be administered in a single pharmaceutical composition, in the same dosage form, or by the same route of administration.

"Administering" means providing a pharmaceutical agent to an individual, and includes, but is not limited to administering by a medical professional and self-administering.

"Amelioration" refers to a lessening of at least one indicator, sign, or symptom of an associated condition or disease. The severity of indicators may be determined by subjective or objective measures, which are known to those skilled in the art.

"Animal" refers to a human or non-human animal, including, but not limited to, mice, rats, rabbits, dogs, cats, pigs, and non-human primates, including, but not limited to, monkeys and chimpanzees.

"Antibody" refers to a molecule characterized by reacting specifically with an antigen in some way, where the antibody and the antigen are each defined in terms of the other. Antibody may refer to a complete antibody molecule or any fragment or region thereof, such as the heavy chain, the light chain, Fab region, and Fc region.

"Antisense compound" means an oligomeric compound that is is capable of undergoing hybridization to a target nucleic acid through hydrogen bonding.

"Antisense inhibition" means reduction of a target nucleic acid levels in the presence of an antisense compound complementary to a target nucleic acid compared to target nucleic acid levels in the absence of the antisense compound.

"Antisense oligonucleotide" means a single-stranded oligonucleotide having a nucleobase sequence that permits hybridization to a corresponding region or segment of a target nucleic acid.

"ApoB-containing lipoprotein" means any lipoprotein that has apolipoprotein B as its protein component, and is understood to include LDL, VLDL, IDL, and lipoprotein(a) and can be generally targeted by lipid lowering agent and therapies.

"Atherosclerosis" means a hardening of the arteries affecting large and medium-sized arteries and is characterized by the presence of fatty deposits. The fatty deposits are called "atheromas" or "plaques," which consist mainly of cholesterol and other fats, calcium, and scar tissue, which damages the lining of arteries.

"Bicyclic sugar" means a furosyl ring modified by the bridging of two non-geminal ring atoms. A bicyclic sugar is a modified sugar.

"Body fat content" refers to the total amount of an animal's adipose tissue mass or weight.

"Body weight" refers to an animal's whole body weight, inclusive of all tissues including adipose tissue.

"Cap structure" or "terminal cap moiety" means chemical modifications, which have been incorporated at either terminus of an antisense compound.

"Cardiovascular disease" refers to a group of disorders/abnormalities associated to the heart, blood vessels, or the circulation. Examples of cardiovascular diseases include, but are not limited to, aneurysm, angina, arrhythmia, atherosclerosis, cerebrovascular disease (stroke), coronary heart disease, dyslipidemia, hyperlipidemia, hypercholesterolemia and hypertension.

"Chimeric antisense compound" means an antisense compound that has at least 2 chemically distinct regions, each position having a plurality of subunits.

"Cholesterol" is a sterol molecule found in the cell membranes of all animal tissues. Cholesterol must be transported in an animal's blood plasma by lipoproteins including very low density lipoprotein (VLDL), intermediate density lipoprotein (IDL), low density lipoprotein (LDL), and high density lipoprotein (HDL). "Plasma cholesterol" refers to the sum of all lipoproteins (VDL, IDL, LDL, HDL) esterified and/or non-estrified cholesterol present in the plasma or serum.

"Co-administration" means administration of two or more pharmaceutical agents to an individual. The two or more pharmaceutical agents may be in a single pharmaceutical composition, or may be in separate pharmaceutical compositions. Each of the two or more pharmaceutical agents may be administered through the same or different routes of administration. Co-administration encompasses administration in parallel or sequentially.

"Complementarity" means the capacity for pairing between nucleobases of a first nucleic acid and a second nucleic acid.

"Comply" means the adherence with a recommended therapy by an individual.

"Comprise," "comprises" and "comprising" will be understood to imply the inclusion of a stated step or element or group of steps or elements but not the exclusion of any other step or element or group of steps or elements.

"Contiguous nucleobases" means nucleobases immediately adjacent to each other.

"Deoxyribonucleotide" means a nucleotide having a hydrogen at the 2' position of the sugar portion of the nucleotide. Deoxyribonucleotides may be modified with any of a variety of substituents.

"Diabetes mellitus" or "diabetes" is a syndrome characterized by disordered metabolism and abnormally high blood sugar (hyperglycemia) resulting from insufficient levels of insulin or reduced insulin sensitivity. The characteristic symptoms are excessive glucose in the urine (glycosuria), excessive urine production (polyuria) due to high blood glucose levels, excessive thirst and increased fluid intake (polydipsia) attempting to compensate for increased urination, blurred vision due to high blood glucose effects on the eye's optics, unexplained weight loss, and lethargy. "Type 2 diabetes," (also known as "type 2 diabetes mellitus" or "diabetes mellitus, type 2", and formerly called "diabetes mellitus type II" , "non-insulin-dependent diabetes (NIDDM)", "obesity related diabetes", or "adult-onset diabetes") is a metabolic disorder that is primarily characterized by insulin resistance, relative insulin deficiency, and hyperglycemia.

"Diabetic dyslipidemia" or "Type 2 diabetes with dyslipidemia" means a condition characterized by Type 2 diabetes, reduced HDL, elevated serum triglycerides, and elevated small, dense LDL particles.

"Diluent" means an ingredient in a composition that lacks pharmacological activity, but is pharmaceutically necessary or desirable. For example, in agents that are injected the diluent may be a liquid, e.g. saline solution.

"Dose" means a specified quantity of a pharmaceutical agent provided in a single administration, or in a specified time period. In certain embodiments, a dose may be administered in one, two, or more boluses, tablets, or injections. For example, in certain embodiments, where subcutaneous administration is desired, the desired dose requires a volume not easily accommodated by a single injection. In certain embodiments, two or more injections may be used to achieve the desired dose. In certain embodiments, a dose may be administered in one, two, or more injections to minimize injection site reaction in an individual. In certain embodiments, the pharmaceutical agent is administered by infusion over an extended period of time or continuously. Doses may be stated as the amount of pharmaceutical agent per hour, day, week or month.

"Dyslipidemia" refers to a disorder of lipid and/or lipoprotein metabolism, including lipid and/or lipoprotein overproduction or deficiency. Dyslipidemia may be manifested by elevation of lipids such as cholesterol and triglycerides as well as lipoproteins such as low-density lipoprotein (LDL) cholesterol.

"Effective amount" in the context of modulating an activity or of treating or preventing a condition means the administration of that amount of active ingredient to a subject in need of such modulation, treatment or prophylaxis, either in a single dose or as part of a series, that is effective for modulation of that effect, or for treatment or prophylaxis or improvement of that condition. The effective amount will vary depending upon the health and physical condition of the subject to be treated, the taxonomic group of subjects to be treated, the formulation of the composition, the assessment of the medical situation, and other relevant factors.

"Elevated apoB-levels" means a subject who has been identified as having apoB levels near or above the level at which therapeutic intervention is recommended, according to guidelines recognized by medical professionals. Such a subject may also be considered "in need of treatment" to decrease apoB levels.

"Fully complementary" means each nucleobase of a first nucleic acid has a complementary nucleobase in a second nucleic acid. In certain embodiments, a first nucleic acid is an antisense compound and a target nucleic acid is a second nucleic acid. In certain embodiments, an antisense oligonucleotide is a first nucleic acid and a target nucleic acid is a second nucleic acid.

"Gapmer" means an antisense compound in which an internal position having a plurality of nucleotides that supports RNaseH cleavage is positioned between external regions having one or more nucleotides that are chemically distinct from the nucleosides of the internal region. A "gap segment" means the plurality of nucleotides that make up the internal region of a gapmer. A "wing segment" means the external region of a gapmer.

"Gap-widened" means an antisense compound has a gap segment of 12 or more contiguous 2'-deoxyribonucleotides positioned between and immediately adjacent to 5' and 3' wing segments having from one to six nucleotides having modified sugar moieties.

"Glucose" is a monosaccharide used by cells as a source of energy and metabolic intermediate. "Plasma glucose" refers to glucose present in the plasma or serum.

"Histone deacetylase inhibitor" refers to any compound capable of inhibiting the enzyme histone deacetyleyase from removing acetyl groups from a lysine amino acid on a histone.

"Hybridization" means the annealing of complementary nucleic acid molecules. In certain embodiments, complementary nucleic acid molecules include, but are not limited to, an antisense compound and a nucleic acid target. In certain embodiments, complementary nucleic acid molecules include, but are not limited to, an antisense oligonucleotide and a nucleic acid target.

"Hypercholesterolemia" means a condition characterized by elevated serum cholesterol levels and/or circulating (plasma) cholesterol levels.

"Hyperglycemia" means a condition characterized by elevated serum glucose levels and/or circulating (plasma) glucose levels.

"Hyperlipidemia" means a condition characterized by elevated serum lipid levels and/or circulating (plasma) lipid levels.

"Hypertension" or "high blood pressure" refers to a progressive disease resulting from persistent functional and structural changes in blood pressure control mechanisms and in the heart and vasculature. Resting blood pressure is frequently 140/90 mm Hg and much higher with physiologic or psychologic stressors.

"Hypertriglyceridemia" means a condition characterized by elevated serum triglyceride levels and/or circulating (plasma) triglyceride levels.

"Hypothyroidism" refers to a condition characterized by diminished production of thyroid hormone, leading to clinical manifestations of thyroid insufficiency, including low metabolic rate and tendency to weight gain.

"Immediately adjacent" means there are no intervening nucleotides between the immediately adjacent elements.

"Identifying" or "selecting an animal having a metabolic or cardiovascular disease" means identifying or selecting an animal having been diagnosed with a metabolic disease, a cardiovascular disease, or a metabolic syndrome; and/or, identifying or selecting an animal having any symptom of a metabolic disease, cardiovascular disease, or metabolic syndrome including, but not limited to, hypercholesterolemia, hyperglycemia, hyperlipidemia, hypertriglyceridemia, hypertension increased insulin resistance, decreased insulin sensitivity, above normal body weight, and/or above normal body fat content or any combination thereof. Such identification may be accomplished by any method, including but not limited to, standard clinical tests or assessments, such as measuring serum or circulating (plasma) cholesterol, measuring serum or circulating (plasma) blood-glucose, measuring serum or circulating (plasma) triglycerides, measuring bloodpressure, calculating BMI, measuring body fat content, measuring body weight, determining body fat distribution, and/or measuring waist circumference and the like.

"Identifying" or "selecting" an animal having hypothyroidism" means identifying or selecting an animal having been diagnosed with hypothyroidism and/or identifying or selecting an animal having any symptom of hypothyroidism such as, but not limited to, decreased production of thyroid hormone, decreased metabolic rate, and/or tendency to weight gain. Such identification may be accomplished by any method, including but not limited to, standard clinical tests or assessments, such as measuring thyroid hormone, measuring T3, measuring T4, measuring body fat content, calculating BMI, measuring body fat content, measuring body weight, determining body fat distribution, and/or measuring waist circumference and the like.

"Identifying" or "selecting" a diabetic animal" means identifying or selecting an animal having been identified as diabetic or identifying or selecting an animal having any symptom of diabetes (type 1 or type 2) such as, but not limited to, having a fasting glucose of at least 110 mg/dL, glycosuria, polyuria, polydipsia, increased insulin resistance, and/or decreased insulin sensitivity. Such identification may be accomplished by any method, including but not limited to, standard clinical tests or assessments, such as measuring fasting serum or circulating (plasma) blood-glucose, and the like.

"Identifying" or "selecting an obese animal" means identifying or selecting an animal having been diagnosed as obese or identifying or selecting an animal with a BMI over 30 and/or a waist circumference of greater than 102 cm in men or greater than 88 cm in women. Such identification may be accomplished by any method, including but not limited to, standard clinical tests or assessments, such as calculating BMI, measuring body fat content, measuring body weight, determining body fat distribution, and/or measuring waist circumference and the like.

"Individual" or "subject" or "animal" means a human or non-human animal selected for treatment or therapy.

"Insulin resistance" means the condition in which normal amounts of insulin are inadequate to produce a normal insulin response from fat, muscle, and liver cells. Insulin resistance in fat cells results in hydrolysis of stored triglycerides, which elevates free fatty acids in the blood plasma. Insulin resistance in muscle reduced glucose update whereas insulin resistance in liver reduced glucose storage, with both effects serving to elevate blood glucose. High plasma levels of insulin and glucose due to insulin resistance often leads to metabolic syndrome and type 2 diabetes.

"Insulin sensitivity" is a measure of how effectively an individual processes glucose. An individual having high insulin sensitivity effectively processes glucose whereas an individual with low insulin sensitivity does not effectively process glucose.

"Internucleoside linkage" refers to the chemical bond between nucleosides.

"Linked nucleosides" means adjacent nucleosides which are bonded together.

"Lipid-lowering agent" means an agent; for example, a SMRT inhibitor provided to a subject to achieve a lowering of lipids in the subject. For example, in certain embodiments, a lipid-lowering agent is provided to a subject to reduce one or more of ApoB, LDL-C, total cholesterol, and triglycerides.

"Lipid-lowering therapy" means a therapeutic regimen provided to a subject to reduce one or more lipids in a subject. In certain embodiments, a lipid-lowering therapy is provided to reduce one or more of ApoB, total cholesterol, LDL-C, VLDL-C, IDL-C, non-HDL-C, triglycerides, small dense LDL particles, and Lp(a) in a subject.

"Metabolic disease" or "metabolic disorder" refers to a condition characterized by an alteration or disturbance in metabolic function. "Metabolic" and "metabolism" are terms well known in the art and generally include the whole range of biochemical processes that occur within a living organism. Metabolic disorders include, but are not limited to, hyperglycemia, prediabetes, diabetes (Type 1 and Type 2), obesity, insulin resistance, metabolic syndrome, and dyslipidemia due to type 2 diabetes.

"Metabolic syndrome" means a condition characterized by a clustering of lipid and non-lipid cardiovascular risk factors of metabolic origin. In certain embodiments, metabolic syndrome is identified by the presence of any 3 of the following factors: waist circumference of greater than 102 cm in men or greater than 88 cm in women; serum triglyceride of at least 150 mg/dL; HDL less than 40 mg/dL in men or less than 50 mg/dL in women; blood pressure of at least 130/85 mmHg; and fasting glucose of at least 110 mg/dL. These determinants can be readily measured in clinical practice (*JAMA,* 2001, 285: 2486-2497).

"Mismatch" or "non-complementary nucleobase" means a nucleobase of first nucleic acid that is not capable of pairing with the corresponding nucleobase of a second or target nucleic acid.

"Mixed dyslipidemia" means a condition characterized by elevated serum cholesterol and elevated serum triglycerides.

"Modified internucleoside linkage" refers to a substitution and/or any change from a naturally occurring internucleoside bond (i.e. a phosphodiester internucleoside bond).

"Modified nucleobase" means any nucleobase other than adenine, cytosine, guanine, thymidine, or uracil. An "unmodified nucleobase" means the purine bases adenine (A) and guanine (G), and the pyrimidine bases thymine (T), cytosine (C) and uracil (U).

"Modified nucleoside" means a nucleoside having, independently, a modified sugar moiety, modified internucleoside linkage, or modified nucleobase. A "modified nucleoside"

means a nucleotide having, independently, a modified sugar moiety or modified nucleobase.

"Modified oligonucleotide" means an oligonucleotide comprising a modification such as a modified internucleoside linkage, a modified sugar, and/or a modified nucleobase.

"Modified sugar" refers to a substitution and/or any change from a natural sugar.

"Motif" means the pattern of unmodified and modified nucleosides in an antisense compound.

"Naturally occurring internucleoside linkage" means a 3' to 5' phosphodiester linkage.

"Natural sugar" means a sugar found in DNA (2'-H) or RNA (2'-OH).

"Nucleic acid" refers to molecules composed of monomeric nucleotides. A nucleic acid includes, but is not limited to, ribonucleic acids (RNA), deoxyribonucleic acids (DNA), single-stranded nucleic acids, double-stranded nucleic acids, small interfering ribonucleic acids (siRNA), and microRNAs (miRNA).

"Nucleobase" means a heterocyclic moiety capable of pairing with a base of another nucleic acid.

"Nucleobase sequence" means the order of contiguous nucleobases independent of any sugar, linkage, and/or nucleobase modification.

"Nucleoside" means a nucleobase linked to a sugar.

"Nucleotide" means a nucleoside having a phosphate group covalently linked to the sugar portion of the nucleoside.

As used herein the term "nucleoside mimetic" is intended to include those structures used to replace the sugar or the sugar and the base and not necessarily the linkage at one or more positions of an oligomeric compound such as for example nucleoside mimetics having morpholino, cyclohexenyl, cyclohexyl, tetrahydropyranyl, bicyclo or tricyclo sugar mimetics e.g. non furanose sugar units.

The term "nucleotide mimetic" is intended to include those structures used to replace the nucleoside and the linkage at one or more positions of an oligomeric compound such as for example peptide nucleic acids or morpholinos (morpholinos linked by —N(H)—C(=O)—O— or other non-phosphodiester linkage).

"Obesity" means an excessively high amount of body fat or adipose tissue in relation to lean body mass. The amount of body fat (or adiposity) includes concern for both the distribution of fat throughout the body and the size or mass of the adipose tissue deposits. Body fat distribution can be estimated by skin-fold measures, waist-to-hip circumference ratios, or techniques such as ultrasound, computed tomography, or magnetic resonance imaging. According to the Center for Disease Control and Prevention, individuals with a body mass index (BMI) of 30 or more are considered obese.

"Oligomeric compound" means a polymer of linked monomeric subunits which is capable of hybridizing to at least a region of a nucleic acid molecule.

"Oligonucleoside" means an oligonucleotide in which the internucleoside linkages do not contain a phosphorus atom.

"Oligonucleotide" means a polymer of linked nucleosides each of which can be modified or unmodified, independent one from another.

"Parenteral administration," means administration through injection or infusion. Parenteral administration includes, but is not limited to, subcutaneous administration, intravenous administration, or intramuscular administration.

"Peptide" means a molecule formed by linking at least two amino acids by amide bonds. Without limitation, as used herein, "peptide" refers to polypeptides and proteins.

"Pharmaceutical agent" means a substance that provides a therapeutic benefit when administered to an individual. For example, in certain embodiments, an antisense oligonucleotide targeted to SMRT is pharmaceutical agent.

"Pharmaceutical composition" means a mixture of substances suitable for administering to an individual. For example, a pharmaceutical composition may comprise one or more antisense oligonucleotides and a sterile aqueous solution.

"Pharmaceutically acceptable carrier" means a medium or diluent that does not interfere with the structure of the oligonucleotide. Certain, of such carries enable pharmaceutical compositions to be formulated as, for example, tablets, pills, dragees, capsules, liquids, gels, syrups, slurries, suspension and lozenges for the oral ingestion by a subject.

"Pharmaceutically acceptable salts" means physiologically and pharmaceutically acceptable salts of antisense compounds, i.e., salts that retain the desired biological activity of the parent oligonucleotide and do not impart undesired toxicological effects thereto.

"Phosphorothioate internucleoside linkage" or "phosphothioate linkage" means a linkage between nucleosides where the phosphodiester bond is modified by replacing one of the non-bridging oxygen atoms with a sulfur atom. A phosphorothioate linkage is a modified internucleoside linkage.

"Portion" means a defined number of contiguous (i.e. linked) nucleobases of a nucleic acid. In certain embodiments, a portion is a defined number of contiguous nucleobases of a target nucleic acid. In certain embodiments, a portion is a defined number of contiguous nucleobases of an antisense compound.

"Prodrug" means a therapeutic agent that is prepared in an inactive or less active form that is converted to an active or more active form (i.e., drug) within the body or cells thereof by the action of endogenous enzymes or other chemicals and/or conditions. In certain embodiments, a shortened oligonucleotide or oligonucleotide metabolite may be more active than it's parent (e.g. 20 mer) oligonucleotide.

"Side effects" means physiological responses attributable to a treatment other than desired effects. In certain embodiments, side effects include, without limitation, injection site reactions, liver function test abnormalities, renal function abnormalities, liver toxicity, renal toxicity, central nervous system abnormalities, and myopathies. For example, increased aminotransferase levels in serum may indicate liver toxicity or liver function abnormality. For example, increased bilirubin may indicate liver toxicity or liver function abnormality.

"Single-stranded oligonucleotide" means an oligonucleotide which is not hybridized to a complementary strand.

"SMRT-specific inhibitor" or "SMRT inhibitor" means any compound capable of decreasing SMRT mRNA or protein expression. Examples of such compounds include a nucleic acid, a peptide, an antibody, or a histone deacetylase inhibitor.

"SMRT-specific modulator" means any compound capable of increasing or decreasing SMRT mRNA or protein expression.

"Subcutaneous administration" means administration just below the skin. "Intravenous administration" means administration into a vein.

The term "sugar surrogate" overlaps with the slightly broader term "nucleoside mimetic" but is intended to indicate replacement of the sugar unit (furanose ring) only. The tetrahydropyranyl rings provided herein are illustrative of an example of a sugar surrogate wherein the furanose sugar group has been replaced with a tetrahydropyranyl ring system.

"Targeted" or "targeted to" means having a nucleobase sequence that will allow hybridization of an antisense compound to a target molecule to induce a desired effect. In certain embodiments, a desired effect is reduction of a target nucleic acid. In certain embodiments, a desired effect is reduction of SMRT mRNA or protein expression.

"Targeting" means the process of design and selection of an antisense compound that will specifically hybridize to a target nucleic acid and induce a desired effect.

"Target nucleic acid," "target RNA," "target RNA transcript" and "nucleic acid target" all mean a nucleic acid capable of being targeted by antisense compounds.

"Target region" means a portion of a target nucleic acid to which one or more antisense compounds is targeted.

"Target segment" refers to a smaller portion or sub-portion of a region within a target nucleic acid. A target segment can be the sequence of nucleotides of a target nucleic acid to which an antisense compound is targeted.

"Therapeutically effective amount" means an amount of a pharmaceutical agent that provides a therapeutic benefit to an individual.

"Triglycerides" means lipids that are the triesters of glycerol.

"Unmodified nucleotide" means a nucleotide composed of naturally occuring nucleobases, sugar moieties and internucleoside linkages. In certain embodiments, an unmodified nucleotide is an RNA nucleotide (i.e., β-D-ribonucleosides) or a DNA nucleotide (i.e., β-D-deoxyribonucleoside).

Nuclear Receptors

Nuclear receptors (NRs) comprise a superfamily of ligand-regulated, DNA-binding transcription factors, which can both activate and repress gene expression. They include receptors for oestrogens (ER-α and ER-β), androgens (ARs), glucocorticoids (GRs), progesterone (PR), thyroid hormones (TRs), vitamin D (VDR), and retinoids/rexinoids (RARs/RXRs). The nuclear receptor family regulates diverse functions including homeostasis, reproduction and development, and metabolism.

Typically, nuclear receptors act in three ways: repression, derepression, and transcriptional activation. Repression occurs via corepressors associated with histone deacetylase (HDAC) activity. Derepression occurs after ligand binding, when the corepressor is disassociated and the first coactivator with histone acetylase transferase (HAT) activity is recruited, followed by chromatin decondensation. Finally, the HAT complex disassociates and the second coactivators bind to the target gene sequence, assemble the basal transcription machinery, and initiate the transcription of the gene.

Coregulators

Coregulators (coactivators and corepressors) are at the crux of critical regulatory aspects of gene expression. Aberrant expression of coregulators have been involved in many human disease states. Among the corepressors are nuclear receptor corepressor (NCoR) and the silencing mediator of retinoid and thyroid hormone receptors (SMRT), which are the major corepressors of NRs and can regulate a broad range of their functions.

Silencing Mediator of Retinoid and Thyroid Hormone Receptor (SMRT)

SMRT is a major corepressor of nuclear receptors and can regulate a broad range of their functions. SMRT mediates transcriptional activity of a wide variety of transcriptional factors including regulators involved in thyroid hormone and retinoic acid signaling. Corepressors, including SMRT, are generally considered undruggable. Small molecules previously designed to target SMRT lack specificity resulting in undesirable side affects.

The present invention addresses these problems encountered in the prior art. The SMRT inhibitors of the present invention are largely distributed to liver and adipose tissue where numerous metabolic pathways function to control glucose and lipid homeostasis. Conversely, the SMRT inhibitors of the present invention are poorly distributed to other tissues, such as cardiac tissue. This is in contrast to small molecule inhibitors which may be distributed to cardiac tissue and cause negative side effects. This type of tissue specificity provides a solution to problems encountered in the prior art.

The present invention relates generally to treatment of diseases associated with lipid dysregulation insulin sensitivity and/or and fat accumulation. Significantly, as presented herein, treatment with a SMRT inhibitor reduces lipids including cholesterol and triglycerides in vivo. This finding is bolstered by a concomitant reduction in lipogenic genes, fatty acid synthesis, sterol synthesis, and increased fatty acid oxidation. Additionally, body weight and body fat content was reduced by treatment with a SMRT inhibitor. SMRT inhibitors are also shown herein to lower glucose and increase insulin sensitivity. This finding is bolstered by concomitant reduction in gluconeogenic genes.

It is therefore an objective herein to treat dyslipidemia and/or obesity with a SMRT inhibitor. As described herein, lipid dysregulation and obesity are significant factors associated with metabolic and/or cardiovascular diseases. As such, it is an objective herein to treat metabolic and cardiovascular diseases, having as a component lipid dysregulation and/or obesity, by administering a SMRT inhibitor. Additionally, hyperlipidemia and increased fat accumulation often accompanies congenital or acquired thyroid deficiency. As such, it is an objective herein to treat hypothyroid states by administering a SMRT inhibitor, especially those individuals with high cardiovascular risk. Treatment may also be combined with other lipid or thyroid modulating agents such as thyroxine.

As identified herein, treatment with a SMRT inhibitor also reduces glucose levels and increases insulin sensitivity.

It is therefore also an objective herein to treat metabolic and/or cardiovascular diseases that have as a component or are characterized by glucose dysregulation and/or insulin resistance or combined lipid and glucose dysregulation and/or insulin resistance with a SMRT inhibitor. It is a particular objective herein to treat individuals with high cardiovascular risk. Such metabolic and/or cardiovascular diseases may also have an obesity component which is treated by the SMRT inhibitor.

SMRT antisense oligonucleotides selectively distribute to liver and fat resulting in inhibition of SMRT mRNA and protein levels specifically in both adipose tissue and liver tissue, as described herein. Thus, antisense oligonucleotide inhibitors of SMRT are useful agents for the treatment of disorders characterized by SMRT expression in adipose tissue (such as adipogenesis and obesity) and liver tissues (such as hepatic steatosis, NAFLD and NASH). Additionally, unlike other SMRT inhibitors an added benefit of using antisense oligonucleotide inhibitors of SMRT is the ability to target both adipose and liver tissues simultaneously, both of which play key roles in metabolic disorders like obesity and diabetes.

The present invention also provides a SMRT-specific modulator as described herein for use in treating or preventing a cardiovascular and/or metabolic disease or disorder as described herein. For example, the invention provides a SMRT-specific modulator as described herein for use in treating or preventing dyslipidemia, atherosclerosis, coronary heart disease, hyperfattyacidemia, or hyperlipoprotenemia, obesity, lipoma, diabetes, atherosclerosis, coronary heart disease, type 2 diabetes, non-alcoholic fatty liver disease (NAFLD), hyperfattyacidemia, and metabolic syndrome, as described herein.

The present invention also provides methods of preventing or delaying the onset of or reducing the risk-factors for a cardiovascular-related or metabolic-related disease or disorder in an animal comprising administering a therapeutically or prophylactically effective amount of a SMRT-specific modulator. In one aspect, the animal is a human. In other aspects, the metabolic and cardiovascular-related disease or disorder includes, but is not limited to obesity, lipoma, lipomatosis, diabetes (including Type 1 diabetes, Type 2 diabetes and Type 2 diabetes with dyslipidemia), dyslipidemia (including hyperlipidemia, hypertriglyceridemia, and mixed dyslipidemia), non-alcoholic fatty liver disease (NAFLD) (including hepatic steatosis and steatohepatitis), hyperfattyacidemia, metabolic syndrome, hyperglycemia, insulin resistance, hypercholesterolemia (including polygenic hypercholesterolemia), coronary heart disease (early onset coronary heart disease), elevated ApoB, or elevated cholesterol (including elevated LDL-cholesterol, elevated VLDL-cholesterol, elevated IDL-cholesterol, and elevated non-HDL cholesterol), as described herein.

The present invention also provides the use of a SMRT-specific modulator in as described herein in the manufacture of a medicament for treating or preventing a cardiovascular and/or metabolic disease or disorder as described herein. For example, the invention provides the use of a SMRT-specific modulator as described herein in the manufacture of a medicament for treating or preventing dyslipidemia, atherosclerosis, coronary heart disease, hyperfattyacidemia, or hyperlipoprotenemia, obesity, lipoma, diabetes, atherosclerosis, coronary heart disease, type 2 diabetes, non-alcoholic fatty liver disease (NAFLD), hyperfattyacidemia, metabolic syndrome, as described herein.

The invention also provides a SMRT-specific modulator as described herein for reducing lipid levels, e.g. for reducing lipid levels in a subject having elevated lipid levels, as described herein. The present invention also provides the use of a SMRT-specific modulator as described herein in the manufacture of a medicament for reducing serum lipid levels, e.g. for reducing serum lipid levels in a subject having elevated serum lipid levels, as described herein.

The invention also provides a SMRT-specific modulator as described herein for reducing cholesterol levels, e.g. for reducing cholesterol levels in a subject having elevated cholesterol levels, as described herein. The present invention also provides the use of a SMRT-specific modulator as described herein in the manufacture of a medicament for reducing cholesterol levels, e.g. for reducing cholesterol levels in a subject having elevated cholesterol levels, as described herein.

The invention also provides a SMRT-specific modulator as described herein for reducing triglyceride levels, e.g. for reducing triglyceride levels in a subject having elevated triglyceride levels, as described herein. The present invention also provides the use of a SMRT-specific modulator as described herein in the manufacture of a medicament for reducing triglyceride levels, e.g. for reducing triglyceride levels in a subject having elevated triglyceride levels, as described herein.

The invention also provides a SMRT-specific modulator as described herein for improving hepatic insulin sensitivity, e.g. for improving hepatic insulin sensitivity in a subject having reduced hepatic insulin sensitivity, as described herein. The present invention also provides the use of a SMRT-specific modulator as described herein in the manufacture of a medicament for improving hepatic insulin sensitivity, e.g. for improving hepatic insulin sensitivity in a subject having reduced hepatic insulin sensitivity, as described herein.

The invention also provides a SMRT-specific modulator as described herein for reducing adipogenesis, e.g. for reducing adipogenesis in a subject having elevated adipose tissue mass or weight, as described herein. The present invention also provides the use of a SMRT-specific modulator as described herein in the manufacture of a medicament for reducing adipogenesis, e.g. for reducing adipogenesis in a subject having elevated adipose tissue mass or weight.

The invention also provides a SMRT-specific modulator as described herein for treating diabetes, e.g. for treating diabetes in a subject having type 2 diabetes with dyslipidemia, as described herein. The present invention also provides the use of a SMRT-specific modulator as described herein in the manufacture of a medicament for treating diabetes, e.g. for treating diabetes in a subject having type 2 diabetes with dyslipidemia, as described herein.

The invention also provides a SMRT-specific modulator as described herein for treating metabolic syndrome, e.g. for treating metabolic syndrome in a subject having metabolic syndrome or one or more risk factors of metabolic syndrome, as described herein. The present invention also provides the use of a SMRT-specific modulator as described herein in the manufacture of a medicament for treating metabolic syndrome, e.g. for treating metabolic syndrome in a subject having metabolic syndrome or one or more risk factors of metabolic syndrome, as described herein.

The invention also provides a SMRT-specific modulator as described herein for use in treating or preventing a cardiovascular and/or metabolic disease or disorder as described herein by combination therapy with an additional therapy as described herein.

The invention also provides a pharmaceutical composition comprising a SMRT-specific modulator as described herein in combination with an additional therapy as described herein. The invention also provides the use of a SMRT-specific modulator as described herein in the manufacture of a medicament for treating or preventing a cardiovascular and/or metabolic disease or disorder as described herein by combination therapy with an additional therapy as described herein.

The invention also provides the use of a SMRT-specific modulator as described herein in the manufacture of a medicament for treating or preventing a cardiovascular and/or metabolic disease or disorder as described herein in a patient who has previously been administered an additional therapy as described herein.

The invention also provides the use of a SMRT-specific modulator as described herein in the manufacture of a medicament for treating or preventing a cardiovascular and/or metabolic disease or disorder as described herein in a patient who is subsequently to be administered an additional therapy as described herein.

The invention also provides a kit for treating or preventing a cardiovascular and/or metabolic disease or disorder as described herein, said kit comprising:
(i) a SMRT-specific modulator as described herein; and
(ii) an additional therapy as described herein.

A kit of the invention may further include instructions for using the kit to treat or prevent a cardiovascular and/or metabolic disease or disorder as described herein by combination therapy as described herein.

In certain embodiments, the SMRT-specific modulator is an antisense compound.

In certain embodiments, the antisense compound is a nucleic acid.

In one embodiment, administration of an antisense compound targeted an SMRT nucleic acid is parenteral administration. Parenteral administration may be intravenous or subcutaneous administration. Accordingly, in another embodiment, administration of an antisense compound targeted to an SMRT nucleic acid is intravenous or subcutaneous administration. Administration may include multiple doses of an antisense compound targeted to an SMRT nucleic acid. In one embodiment, administration of an antisense compound targeted an SMRT nucleic acid is oral administration.

Certain Embodiments

Antisense compounds described herein may comprise an oligonucleotide consisting of 12 to 30 linked nucleosides targeted to a SMRT nucleic acid. In certain embodiments, the SMRT nucleic acid may be any of the sequences set forth in GENBANK Acecession No. AF125672.1, GENBANK accession number NM_006312.1, the complement of residues 39001-260000 of GENBANK accession number NT_009459.3.

Also described herein are methods for treating an animal having a metabolic or cardiovascular disease.

In certain embodiments, the method comprises identifying or selecting an animal having a metabolic or cardiovascular disease and administering to the animal having a metabolic or cardiovascular disease a therapeutically effective amount of a SMRT inhibitor.

In certain embodiments, the SMRT inhibitor is any of the group consisting of a nucleic acid, a peptide, an antibody, or a histone deacetylase inhibitor.

In certain embodiments, the nucleic acid is a modified oligonucleotide.

In certain embodiments, the modified oligonucleotide may be a single-stranded or double-stranded oligonucleotide. The modified oligonucleotide may be 70, 75, 80, 85, 90, 95, or 100% complementary to a human SMRT nucleic acid.

The modified oligonucleotide may have at least one modified internucleoside linkage. The internucleoside linkage may be a phosphorothioate internucleoside linkage.

The modified oligonucleotide may have at least one modified sugar. The modified sugar may be a bicyclic sugar. The modified sugar may comprise a 2'-O-methoxyethyl.

The modified oligonucleotide may comprise at least one nucleoside having a modified nucleobase.

The modified oligonucleotide may comprise or consist of the nucleobase sequence of any of SEQ ID NO: 5 to 41.

In certain embodiments, the method comprises identifying or selecting an animal having a metabolic or cardiovascular disease and administering to the animal having a metabolic or cardiovascular disease a therapeutically effective amount of a compound comprising a modified oligonucleotide consisting of 12 to 30 linked nucleosides, wherein the modified oligonucleotide is complementary to human SMRT.

In certain embodiments, the metabolic or cardiovascular disease is obesity, diabetes, or dyslipidemia, or a combination thereof.

In certain embodiments, the disease is dyslipidemia.

In certain embodiments, the disease the dyslipidemia is hyperlipidemia.

In certain embodiments, the hyperlipidemia is hypercholesterolemia, hypertriglyceridemia, or both hypercholesterolemia and hypertriglyceridemia.

In certain embodiments the method results in a reduction of triglyceride levels.

In certain embodiments, the method results in a reduction of triglyceride levels of at least 20, 30, 35, or 40%.

In certain embodiments, the method results in a reduction of cholesterol levels.

In certain embodiments, the method results in a reduction of cholesterol levels by at least 10, 20, 30, 35 or 40%.

In another embodiment, the method results in a reduction of glucose levels.

In certain embodiments, the method results in a reduction of glucose levels by at least 5 or 10%.

In certain embodiments, the method results in a reduction of body weight.

In certain embodiments, the method results in a reduction of body weight by at least 10 or 15%.

In certain embodiments, the method results in a reduction of body fat.

In certain embodiments, the method results in a reduction of body fat by at least 10, 20, 30, or 40%.

In certain embodiments, the method results in a reduction of triglyceride levels, cholesterol levels, glucose levels, body weight, fat content, insulin resistance, or any combination thereof, wherein levels are independently reduced by 5%, 10%, or 15%.

In certain embodiments, the method comprises identifying or selecting an obese animal and administering to the obese animal a therapeutically effective amount of a SMRT inhibitor.

In certain embodiments, the method results in a reduction of body fat.

In certain embodiments, the method results in a reduction of body fat by at least 10, 20, 30, or 40%.

In certain embodiments, the method comprises identifying or selecting a diabetic animal and administering to the diabetic animal a therapeutically effective amount of a SMRT inhibitor.

In certain embodiments, the method results in a reduction of glucose levels.

In certain embodiments, the method results in a reduction of glucose level by at least 10 or 15%.

In certain embodiments, the method results in improved insulin sensitivity.

In certain embodiments, the method comprises identifying or selecting an animal having hypothyroidism and administering to the animal having hypothyroidism a therapeutically effective amount of a SMRT inhibitor.

In certain embodiments, the method results in reduction of triglycerides, cholesterol, and glucose.

SMRT Inhibitors

SMRT can be inhibited by numerous molecules. In certain embodiments SMRT is inhibited by nucleic acids including, but not limited to, single stranded nucleic acids, double stranded nucleic acids, antisense oligonucleotides, and small interfering RNA (siRNA).

In certain embodiments SMRT is inhibited by peptides, polypeptides, and proteins including, but not limited to TBL1-related protein (TBL1R1) and promyelocytic leukemia-retinoic acid receptor alpha (PML-RAR alpha).

In certain embodiments SMRT is inhibited by antibodies.

In certain embodiments SMRT is inhibited by a histone deacetylase inhibitor including, but not limited to, butyrate, trichostatin A, suberoylanilide hydroxamic acid, m-carboxycinnamic acid bis-hydroxamide (CBHA), oxamflatin, CHAP, trapoxin A, apicidin, depsipeptide, and MS-27-275.

In certain embodiments SMRT is inhibited by colchicine (COL) and all-trans retinoic acid (ATRA), valproic acid.

SMRT knock-out animal models are embryonic lethal.

Antisense Compounds

Oligomeric compounds include, but are not limited to, oligonucleotides, oligonucleosides, oligonucleotide analogs, oligonucleotide mimetics, antisense compounds, antisense oligonucleotides, and siRNAs. An oligomeric compound may be "antisense" to a target nucleic acid, meaning that is capable of undergoing hybridization to a target nucleic acid through hydrogen bonding.

In certain embodiments, an antisense compound has a nucleobase sequence that, when written in the 5' to 3' direction, comprises the reverse complement of the target segment of a target nucleic acid to which it is targeted. In certain embodiments an antisense oligonucleotide has a nucleobase sequence that, when written in the 5' to 3' direction, comprises the reverse complement of the target segment of a target nucleic acid to which it is targeted.

In certain embodiments an antisense compound targeted to a SMRT nucleic acid is 12 to 30 subunits in length. In other words, antisense compounds are from 12 to 30 linked subunits. In certain embodiments, the antisense compound is 8 to 80, 12 to 50, 15 to 30, 18 to 24, 19 to 22, or 20 linked subunits. In certain embodiments, the antisense compounds are 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 linked subunits in length, or a range defined by any two of the above values. In certain embodiments, the antisense compound is an antisense oligonucleotide, and the linked subunits are nucleotides.

In another embodiment, the antisense compounds comprise at least 8 contiguous nucleobases of an antisense compound disclosed herein. In certain embodiments, the antisense compounds comprises at least 9, 10, 11, 12, 13, 14, 15, 16, 17, 18, 19, or 20 contiguous nucleobases of an antisense compound disclosed herein.

Antisense compounds 12 to 30, 8 to 80, 12 to 50, 15 to 30, 18 to 24, 19 to 22, or 20 nucleobase in length comprising a stretch of at least eight (8) consecutive nucleobases selected from within the illustrative antisense compounds are considered to be suitable antisense compounds as well.

In certain embodiments, a shortened or truncated antisense compound targeted to a SMRT nucleic acid has a single subunit deleted from the 5' end (5' truncation), or alternatively from the 3' end (3' truncation). A shortened or truncated antisense compound targeted to a SMRT nucleic acid may have two subunits deleted from the 5' end, or alternatively may have two subunits deleted from the 3' end, of the antisense compound. Alternatively, the deleted nucleosides may be dispersed throughout the antisense compound, for example, in an antisense compound having one nucleoside deleted from the 5' end and one nucleoside deleted from the 3' end.

When a single additional subunit is present in a lengthened antisense compound, the additional subunit may be located at the 5' or 3' end of the antisense compound. When two are more additional subunits are present, the added subunits may be adjacent to each other, for example, in an antisense compound having two subunits added to the 5' end (5' addition), or alternatively to the 3' end (3' addition), of the antisense compound. Alternatively, the added subunits may be dispersed throughout the antisense compound, for example, in an antisense compound having one subunit added to the 5' end and one subunit added to the 3' end.

It is possible to increase or decrease the length of an antisense compound, such as an antisense oligonucleotide, and/or introduce mismatch bases without eliminating activity. For example, in Woolf et al. (Proc. Natl. Acad. Sci. USA 89:7305-7309, 1992), a series of antisense oligonucleotides 13-25 nucleobases in length were tested for their ability to induce cleavage of a target RNA in an oocyte injection model. Antisense oligonucleotides 25 nucleobases in length with 8 or 11 mismatch bases near the ends of the antisense oligonucleotides were able to direct specific cleavage of the target mRNA, albeit to a lesser extent than the antisense oligonucleotides that contained no mismatches. Similarly, target specific cleavage was achieved using 13 nucleobase antisense oligonucleotides, including those with 1 or 3 mismatches.

Gautschi et al (J. Natl. Cancer Inst. 93:463-471, March 2001) demonstrated the ability of an oligonucleotide having 100% complementarity to the bcl-2 mRNA and having 3 mismatches to the bel-xL mRNA to reduce the expression of both bcl-2 and bcl-xL in vitro and in vivo. Furthermore, this oligonucleotide demonstrated potent anti-tumor activity in vivo.

Maher and Dolnick (Nuc. Acid. Res. 16:3341-3358,1988) tested a series of tandem 14 nucleobase antisense oligonucleotides, and a 28 and 42 nucleobase antisense oligonucleotides comprised of the sequence of two or three of the tandem antisense oligonucleotides, respectively, for their ability to arrest translation of human DHFR in a rabbit reticulocyte assay. Each of the three 14 nucleobase antisense oligonucleotides alone was able to inhibit translation, albeit at a more modest level than the 28 or 42 nucleobase antisense oligonucleotides.

Antisense Compound Motifs

In certain embodiments, antisense compounds targeted to a SMRT nucleic acid have chemically modified subunits arranged in patterns, or motifs, to confer to the antisense compounds properties such as enhanced the inhibitory activity, increased binding affinity for a target nucleic acid, or resistance to degradation by in vivo nucleases.

Chimeric antisense compounds typically contain at least one region modified so as to confer increased resistance to nuclease degradation, increased cellular uptake, increased binding affinity for the target nucleic acid, and/or increased inhibitory activity. A second region of a chimeric antisense compound may optionally serve as a substrate for the cellular endonuclease RNase H, which cleaves the RNA strand of an RNA:DNA duplex.

Antisense compounds having a gapmer motif are considered chimeric antisense compounds. In a gapmer an internal region having a plurality of nucleotides that supports RNaseH cleavage is positioned between external regions having a plurality of nucleotides that are chemically distinct from the nucleosides of the internal region. In the case of an antisense oligonucleotide having a gapmer motif, the gap segment generally serves as the substrate for endonuclease cleavage, while the wing segments comprise modified nucleosides. In certain embodiments, the regions of a gapmer are differentiated by the types of sugar moieties comprising each distinct region. The types of sugar moieties that are used to differentiate the regions of a gapmer may In certain embodiments, include β-D-ribonucleosides, β-D-deoxyribonucleosides, 2'-modified nucleosides (such 2'-modified nucleosides may include 2'-MOE, and 2'-O—CH$_3$, among others), and bicyclic sugar modified nucleosides (such bicyclic sugar modified nucleosides may include those having a 4'-(CH2)n-O-2' bridge, where n=1 or n=2). Preferably, each distinct region comprises uniform sugar moieties. The wing-gap-wing motif is frequently described as "X-Y-Z", where "X" represents the length of the 5' wing region, "Y" represents the length of the gap region, and "Z" represents the length of the 3' wing region. Any of the antisense compounds described herein can have a gapmer motif. In certain embodiments, X and Z are the same, in certain other embodiments, they are different. In certain embodiments, Y is between 8 and 15 nucleotides. X, Y or Z can be any of 1, 2, 3, 4, 5, 6, 7, 8, 9, 10, 11, 12, 13, 14, 15, 16, 17, 18, 19, 20, 25, 30 or more nucleotides. Thus, gapmers of the present invention include, but are not limited to, for example 5-10-5, 4-8-4, 4-12-3, 4-12-4, 3-14-3, 2-16-2, 1-18-1, 3-10-3, 2-10-2, 1-10-1 or 2-8-2.

In certain embodiments, the antisense compound as a "wingmer" motif, having a wing-gap or gap-wing configuration, i.e. an X-Y or Y-Z configuration as described above for the gapmer configuration. Thus, wingmer configurations of the present invention include, but are not limited to, for example 5-10, 8-4, 4-12, 12-4, 3-14, 16-2, 18-1, 10-3, 2-10, 1-10 or 8-2.

In certain embodiments, antisense compounds targeted to a SMRT nucleic acid possess a 5-10-5 gapmer motif.

In certain embodiments, an antisense compound targeted to a SMRT nucleic acid has a gap-widened motif. In other embodiments, an antisense oligonucleotide targeted to a SMRT nucleic acid has a gap-widened motif.

In certain embodiments, a gap-widened antisense oligonucleotide targeted to a SMRT nucleic acid has a gap segment of fourteen 2'-deoxyribonucleotides positioned between wing segments of three chemically modified nucleosides. In certain embodiments, the chemical modification comprises a 2'-sugar modification. In certain embodiments, the chemical modification comprises a 2'-MOE sugar modification.

Target Nucleic Acids, Target Regions and Nucleotide Sequences

Nucleotide sequences that encode SMRT include, without limitation, the following: GenBank accession number AF125672.1, first deposited with GenBank on Apr. 4, 1999, and incorporated herein as SEQ ID NO: 1; GenBank accession number NM_006312.1, first deposited with GenBank on Oct. 28, 2004, and incorporated herein as SEQ ID NO: 2; the complement of residues 39001-260000 of GenBank accession number NT_009459.3, representing a partial genomic sequence of SMRT, first deposited with GenBank on May 8, 2002, and incorporated herein as SEQ ID NO: 3; and GenBank accession number AK147394.1, first deposited with GenBank on Oct. 5, 2006, and incorporated herein as SEQ ID NO: 4).

It is understood that the sequence set forth in each SEQ ID NO in the Examples contained herein is independent of any modification to a sugar moiety, an internucleoside linkage, or a nucleobase. As such, antisense compounds defined by a SEQ ID NO may comprise, independently, one or more modifications to a sugar moiety, an internucleoside linkage, or a nucleobase. Antisense compounds described by Isis Number (Isis No) indicate a combination of nucleobase sequence and motif.

In certain embodiments, a target region is a structurally defined region of the nucleic acid. For example, a target region may encompass a 3' UTR, a 5' UTR, an exon, an intron, a coding region, a translation initiation region, translation termination region, or other defined nucleic acid region. The structurally defined regions for SMRT can be obtained by accession number from sequence databases such as NCBI and such information is incorporated herein by reference. In certain other embodiments, a target region may encompass the sequence from a 5' target site of one target segment within the target region to a 3' target site of another target segment within the target region.

Targeting includes determination of at least one target segment to which an antisense compound hybridizes, such that a desired effect occurs. In certain embodiments, the desired effect is a reduction in mRNA target nucleic acid levels. In certain other embodiments, the desired effect is reduction of levels of protein encoded by the target nucleic acid or a phenotypic change associated with the target nucleic acid.

A target region may contain one or more target segments. Multiple target segments within a target region may be overlapping. Alternatively, they may be non-overlapping. In certain embodiments, target segments within a target region are separated by no more than about 300 nucleotides. In other emodiments, target segments within a target region are separated by no more than about, 250, 200, 150, 100, 90, 80, 70, 60, 50, 40, 30, 20, or 10 nucleotides on the target nucleic acid. In certain embodiments, target segments within a target region are separated by no more than about 5 nucleotides on the target nucleic acid. In certain embodiments, target segments are contiguous.

Suitable target segments may be found within a 5' UTR, a coding region, a 3' UTR, an intron, or an exon. Target segments containing a start codon or a stop codon are also suitable target segments. A suitable target segment may specifically exclude a certain structurally defined region such as the start codon or stop codon.

The determination of suitable target segments may include a comparison of the sequence of a target nucleic acid to other sequences throughout the genome. For example, the BLAST algorithm may be used to identify regions of similarity amongst different nucleic acids. This comparison can prevent the selection of antisense compound sequences that may hybridize in a non-specific manner to sequences other than a selected target nucleic acid (i.e., non-target or off-target sequences).

There may be variation in activity (e.g., as defined by percent reduction of target nucleic acid levels) of the antisense compounds within an active target region. In certain embodiments, reductions in SMRT mRNA levels are indicative of inhibition of SMRT expression. Reductions in levels of a SMRT protein are also indicative of inhibition of target mRNA expression. Further, phenotypic changes are indicative of inhibition of SMRT expression. For example, phenotypic changes may include reduction in serum glucose concentration, an improved lipid profile, changes in hormone or adipokine levels, and changes to the amount of and/or location of fat deposits on an individual. In certain embodiments, phenotypic changes include a decrease in plasma glucose, plasma triglycerides, plasma cholesterol, and body weight. In certain embodiments, LDL cholesterol is decreased and HDL cholesterol is increased. In certain embodiments, changes may include an increase in tissue thyroid hormone action, resulting in reduced TSH levels and/or normalization of serum thyroxine levels. In certain embodiments, changes may include concomitant reduction in hyperlipidemia, obesity, and normalization of thyroid action in hypothyroid patients.

Hybridization

In certain embodiments, hybridization occurs between an antisense compound disclosed herein and a SMRT nucleic acid. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Stringent conditions are sequence-dependent and are determined by the nature and composition of the nucleic acid molecules to be hybridized.

Methods of determining whether a sequence is specifically hybridizable to a target nucleic acid are well known in the art. In certain embodiments, the antisense compounds provided herein are specifically hybridizable with a SMRT nucleic acid.

Complementarity

An antisense compound and a target nucleic acid are complementary to each other when a sufficient number of nucleobases of the antisense compound can hydrogen bond with the corresponding nucleobases of the target nucleic acid, such that a desired effect will occur (e.g., antisense inhibition of a target nucleic acid, such as a SMRT nucleic acid).

Non-complementary nucleobases between an antisense compound and a SMRT nucleic acid may be tolerated provided that the antisense compound remains able to specifically hybridize to a target nucleic acid. Moreover, an antisense compound may hybridize over one or more segments of a SMRT nucleic acid such that intervening or adjacent segments are not involved in the hybridization event (e.g., a loop structure, mismatch or hairpin structure).

In certain embodiments, the antisense compounds provided herein are at least 70%, at least 75%, at least 80%, at least 85%, at least 90%, at least 95%, at least 96%, at least 97%, at least 98% or at least 99% complementary to a SMRT nucleic acid. Percent complementarity of an antisense compound with a target nucleic acid can be determined using routine methods.

For example, an antisense compound in which 18 of 20 nucleobases of the antisense compound are complementary to a target region, and would therefore specifically hybridize, would represent 90 percent complementarity. In this example, the remaining noncomplementary nucleobases may be clustered or interspersed with complementary nucleobases and need not be contiguous to each other or to complementary nucleobases. As such, an antisense compound which is 18 nucleobases in length having 4 (four) noncomplementary nucleobases which are flanked by two regions of complete complementarity with the target nucleic acid would have 77.8% overall complementarity with the target nucleic acid and would thus fall within the scope of the present invention. Percent complementarity of an antisense compound with a region of a target nucleic acid can be determined routinely using BLAST programs (basic local alignment search tools) and PowerBLAST programs known in the art (Altschul et al., J. Mol. Biol., 1990, 215, 403 410; Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, the antisense compounds provided herein are fully complementary (i.e, 100% complementary) to a target nucleic acid. For example, antisense compound may be fully complementary to a SMRT nucleic acid, or a target region, or a target segment or target sequence thereof. As used herein, "fully complementary" means each nucleobase of an antisense compound is capable of precise base pairing with the corresponding nucleobases of a target nucleic acid.

The location of a non-complementary nucleobase may be at the 5' end or 3' end of the antisense compound. Alternatively, the non-complementary nucleobase or nucleobases may be at an internal position of the antisense compound. When two or more non-complementary nucleobases are present, they may be contiguous (i.e. linked) or non-contiguous. In certain embodiments, non-complementary nucleobase is located in the wing segment of a gapmer antisense oligonucleotide.

In certain embodiments, antisense compounds up to 20 nucleobases in length comprise no more than 4, no more than 3, no more than 2 or no more than 1 non-complementary nucleobase(s) relative to a target nucleic acid, such as a SMRT nucleic acid.

In certain embodiments, antisense compounds up to 30 nucleobases in length comprise no more than 6, no more than 5, no more than 4, no more than 3, no more than 2 or no more than 1 non-complementary nucleobase(s) relative to a target nucleic acid, such as a SMRT nucleic acid.

The antisense compounds provided herein also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of an antisense compound. In certain embodiments, the antisense compounds are complementary to at least an 8 nucleobase portion of a target segment. In certain embodiments, the antisense compounds are complementary to at least a 12 nucleobase portion of a target segment. In certain embodiments, the antisense compounds are complementary to at least a 15 nucleobase portion of a target segment. Also contemplated are antisense compounds that are complementary to at least a 9, 10, 11, 12, 13, 14, 15, 16, 17, 18, 19, 20, or more nucleobase portion of a target segment, or a range defined by any two of these values.

In certain embodiments, the antisense compounds provided herein include those comprising a portion which consists of at least 8, 9, 10, 11, 12, 13, 14, 15, 16, 17, 18, 19, or 20 contiguous nucleobases of the nucleobase sequence set forth in SEQ ID NOs: 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, or 41. In certain embodiments, the antisense compounds are complementary to an equal-length portion of SEQ ID NOs: 1, 2, or 3. In certain embodiments, the antisense compounds are at least 75%, 80%, 85%, 90%, 95%, or 100% (fully) complementary to SEQ ID NOs: 1, 2, or 3.

Identity

The antisense compounds provided herein may also have a defined percent identity to a particular nucleotide sequence, SEQ ID NO, or compound represented by a specific Isis number. As used herein, an antisense compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine. Shortened and lengthened versions of the antisense compounds described herein as well as compounds having non-identical bases relative to the antisense compounds provided herein also are contemplated. The non-identical bases may be adjacent to each other or dispersed throughout the antisense compound. Percent identity of an antisense compound is calculated according to the number of bases that have identical base pairing relative to the sequence to which it is being compared.

In certain embodiments, the antisense compounds are at least 70%, 75%, 80%, 85%, 90%, 95%, 96%, 97%, 98%, 99% or 100% identical to one or more of the antisense compounds or SEQ ID NOs, or a portion thereof, disclosed herein.

Modifications

A nucleoside is a base-sugar combination. The nucleobase (also known as base) portion of the nucleoside is normally a heterocyclic base moiety. Nucleotides are nucleosides that further include a phosphate group covalently linked to the sugar portion of the nucleoside. For those nucleosides that include a pentofuranosyl sugar, the phosphate group can be linked to the 2', 3' or 5' hydroxyl moiety of the sugar. Oligonucleotides are formed through the covalent linkage of adjacent nucleosides to one another, to form a linear polymeric oligonucleotide. Within the oligonucleotide structure, the phosphate groups are commonly referred to as forming the internucleoside linkages of the oligonucleotide.

Modifications to antisense compounds encompass substitutions or changes to internucleoside linkages, sugar moieties, or nucleobases. Modified antisense compounds are often preferred over native forms because of desirable properties such as, for example, enhanced cellular uptake, enhanced affinity for nucleic acid target, increased stability in the presence of nucleases, or increased inhibitory activity.

Chemically modified nucleosides may also be employed to increase the binding affinity of a shortened or truncated antisense oligonucleotide for its target nucleic acid. Consequently, comparable results can often be obtained with shorter antisense compounds that have such chemically modified nucleosides.

Modified Internucleoside Linkages

The naturally occuring internucleoside linkage of RNA and DNA is a 3' to 5' phosphodiester linkage. Antisense compounds having one or more modified, i.e. non-naturally occurring, internucleoside linkages are often selected over antisense compounds having naturally occurring internucleoside linkages because of desirable properties such as, for example, enhanced cellular uptake, enhanced affinity for target nucleic acids, and increased stability in the presence of nucleases.

Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, antisense compounds targeted to a SMRT nucleic acid comprise one or more modified internucleoside linkages. In certain embodiments, the modified internucleoside linkages are phosphorothioate linkages. In certain embodiments, each internucleoside linkage of an antisense compound is a phosphorothioate internucleoside linkage.

Modified Sugar Moieties

Antisense compounds of the invention can optionally contain one or more nucleotides having modified sugar moieties. Sugar modifications may impart nuclease stability, binding affinity or some other beneficial biological property to the antisense compounds. The furanosyl sugar ring of a nucleoside can be modified in a number of ways including, but not limited to: addition of a substituent group, particularly at the 2' position; bridging of two non-geminal ring atoms to form a bicyclic nucleic acid (BNA); and substitution of an atom or group such as —S—, —N(R)— or —C($R_1$)($R_2$) for the ring oxygen at the 4'-position. Modified sugars include, but are not limited to: substituted sugars, especially 2'-substituted sugars having a 2'-F, 2'-OCH$_2$ (2'-OMe) or a 2'-O(CH$_2$)$_2$—OCH$_3$ (2'-O-methoxyethyl or 2'MOE) substituent group; and bicyclic modified sugars (BNAs), having a 4'-(CH$_2$)$_n$—O-2' bridge, where n=1 or n=2. Methods for the preparations of modified sugars are well known to those skilled in the art.

Examples of nucleosides having modified sugar moieties include without limitation nucleosides comprising 5'-vinyl, 5'-methyl (R or S), 4'-S, 2'-F, 2'-OCH$_3$ and 2'-O(CH$_2$)$_2$OCH$_3$ substituent groups. The substituent at the 2' position can also be selected from allyl, amino, azido, thio, O-allyl, O—C$_1$-C$_{10}$ alkyl, OCF$_3$, O(CH$_2$)$_2$SCH$_3$, O(CH$_2$)$_2$—O—N(R$_m$)(R$_n$), and O—CH$_2$—C(=O)—N(R$_m$)(R$_n$), where each R$_m$ and R$_n$ is, independently, H or substituted or unsubstituted C$_1$-C$_{10}$ alkyl.

Examples of bicyclic nucleic acids (BNAs) include without limitation nucleosides comprising a bridge between the 4' and the 2' ribosyl ring atoms. In certain embodiments, antisense compounds provided herein include one or more BNA nucleosides wherein the bridge comprises one of the formulas: 4'-(CH$_2$)—O-2' (LNA); 4'-(CH$_2$)—S-2'; 4'-(CH$_2$)—O-2' (LNA); 4'-(CH$_2$)$_2$—O-2' (ENA); 4'-C(CH$_3$)$_2$—O-2' (see PCT/US2008/068922); 4'-CH(CH$_3$)—O-2' and 4'-CH(CH$_2$OCH$_3$)—O-2' (see U.S. Pat. No. 7,399,845, issued on Jul. 15, 2008); 4'-CH$_2$—N(OCH$_3$)-2' (see PCT/US2008/064591); 4'-CH$_2$—O—N(CH$_3$)-2' (see published U.S. Patent Application US2004-0171570, published Sep. 2, 2004); 4'-CH$_2$—N(R)—O-2' (see U.S. Pat. No. 7,427,672, issued on Sep. 23, 2008); 4'-CH$_2$—C(CH$_3$)-2' and 4'-CH$_2$—C(=CH$_2$-2' (see PCT/US2008/066154); and wherein R is, independently, H, C$_1$-C$_{12}$ alkyl, or a protecting group. Each of the foregoing BNAs include various stereochemical sugar configurations including for example α-L-ribofuranose and β-D-ribofuranose (see PCT international application PCT/DK98/00393, published on Mar. 25, 1999 as WO 99/14226).

In certain embodiments, nucleosides are modified by replacement of the ribosyl ring with a sugar surrogate. Such modification includes without limitation, replacement of the ribosyl ring with a surrogate ring system (sometimes referred to as DNA analogs) such as a morpholino ring, a cyclohexenyl ring, a cyclohexyl ring or a tetrahydropyranyl ring such as one having one of the formula:

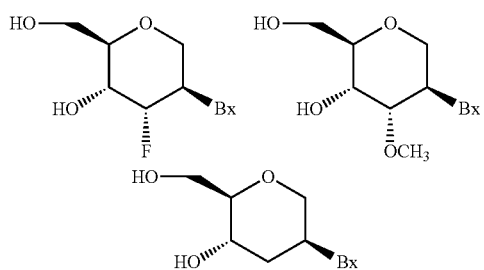

Many other bicyclo and tricyclo sugar surrogate ring systems are also know in the art that can be used to modify nucleosides for incorporation into antisense compounds (see for example review article: Leumann, Christian J.). Such ring systems can undergo various additional substitutions to enhance activity.

In nucleotides having modified sugar moieties, the nucleobase moieties (natural, modified or a combination thereof) are maintained for hybridization with an appropriate nucleic acid target.

In certain embodiments, antisense compounds targeted to a SMRT nucleic acid comprise one or more nucleotides having modified sugar moieties. In certain embodiments, the modified sugar moiety is 2'-MOE. In certain embodiments, the 2'-MOE modified nucleotides are arranged in a gapmer motif.

Modified Nucleobases

Nucleobase (or base) modifications or substitutions are structurally distinguishable from, yet functionally interchangeable with, naturally occurring or synthetic unmodified nucleobases. Both natural and modified nucleobases are capable of participating in hydrogen bonding. Such nucleobase modifications may impart nuclease stability, binding affinity or some other beneficial biological property to antisense compounds. Modified nucleobases include synthetic and natural nucleobases such as, for example, 5-methylcytosine (5-me-C). Certain nucleobase substitutions, including 5-methylcytosine substitutions, are particularly useful for increasing the binding affinity of an antisense compound for a target nucleic acid. For example, 5-methylcytosine substitutions have been shown to increase nucleic acid duplex stability by 0.6-1.2° C. (Sanghvi, Y. S., Crooke, S. T. and Lebleu, B., eds., *Antisense Research and Applications*, CRC Press, Boca Raton, 1993, pp. 276-278).

Additional unmodified nucleobases include 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl ($-C\equiv C-CH_3$) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine and 3-deazaguanine and 3-deazaadenine.

Heterocyclic base moieties may also include those in which the purine or pyrimidine base is replaced with other heterocycles, for example 7-deaza-adenine, 7-deazaguanosine, 2-aminopyridine and 2-pyridone. Nucleobases that are particularly useful for increasing the binding affinity of antisense compounds include 5-substituted pyrimidines, 6-azapyrimidines and N-2, N-6 and O-6 substituted purines, including 2 aminopropyladenine, 5-propynyluracil and 5-propynylcytosine.

In certain embodiments, antisense compounds targeted to a SMRT nucleic acid comprise one or more modified nucleobases. In certain embodiments, gap-widened antisense oligonucleotides targeted to a SMRT nucleic acid comprise one or more modified nucleobases. In certain embodiments, the modified nucleobase is 5-methylcytosine. In certain embodiments, each cytosine is a 5-methylcytosine.

Compositions and Methods for Formulating Pharmaceutical Compositions

Antisense oligonucleotides may be admixed with pharmaceutically acceptable active and/or inert substances for the preparation of pharmaceutical compositions or formulations. Compositions and methods for the formulation of pharmaceutical compositions are dependent upon a number of criteria, including, but not limited to, route of administration, extent of disease, or dose to be administered.

Antisense compound targeted to a SMRT nucleic acid can be utilized in pharmaceutical compositions by combining the antisense compound with a suitable pharmaceutically acceptable diluent or carrier. A pharmaceutically acceptable diluent includes phosphate-buffered saline (PBS). PBS is a diluent suitable for use in compositions to be delivered parenterally. Accordingly, In certain embodiments, employed in the methods described herein is a pharmaceutical composition comprising an antisense compound targeted to a SMRT nucleic acid and a pharmaceutically acceptable diluent. In certain embodiments, the pharmaceutically acceptable diluent is PBS. In certain embodiments, the antisense compound is an antisense oligonucleotide.

Pharmaceutical compositions comprising antisense compounds encompass any pharmaceutically acceptable salts, esters, or salts of such esters, or any other oligonucleotide which, upon administration to an animal, including a human, is capable of providing (directly or indirectly) the biologically active metabolite or residue thereof. Accordingly, for example, the disclosure is also drawn to pharmaceutically acceptable salts of antisense compounds, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of an antisense compound which are cleaved by endogenous nucleases within the body, to form the active antisense compound.

Conjugated Antisense Compounds

Antisense compounds may be covalently linked to one or more moieties or conjugates which enhance the activity, cellular distribution or cellular uptake of the resulting antisense oligonucleotides. Typical conjugate groups include cholesterol moieties and lipid moieties. Additional conjugate groups include carbohydrates, phospholipids, biotin, phenazine, folate, phenanthridine, anthraquinone, acridine, fluoresceins, rhodamines, coumarins, and dyes.

Antisense compounds can also be modified to have one or more stabilizing groups that are generally attached to one or both termini of antisense compounds to enhance properties such as, for example, nuclease stability. Included in stabilizing groups are cap structures. These terminal modifications protect the antisense compound having terminal nucleic acid from exonuclease degradation, and can help in delivery and/or localization within a cell. The cap can be present at the 5'-terminus (5'-cap), or at the 3'-terminus (3'-cap), or can be present on both termini. Cap structures are well known in the art and include, for example, inverted deoxy abasic caps. Further 3' and 5'-stabilizing groups that can be used to cap one or both ends of an antisense compound to impart nuclease stability include those disclosed in WO 03/004602 published on Jan. 16, 2003.

Cell Culture and Antisense Compounds Treatment

The effects of antisense compounds on the level, activity or expression of SMRT nucleic acids can be tested in vitro in a variety of cell types. Cell types used for such analyses are available from commerical vendors (e.g. American Type Culture Collection, Manassus, Va.; Zen-Bio, Inc., Research Triangle Park, N.C.; Clonetics Corporation, Walkersville, Md.) and cells are cultured according to the vendor's instructions using commercially available reagents (e.g. Invitrogen Life Technologies, Carlsbad, Calif.). Illustrative cell types include, but are not limited to, Hep3B cells and primary hepatocytes.

In vitro Testing of Antisense Oligonucleotides

Described herein are methods for treatment of cells with antisense oligonucleotides, which can be modified appropriately for treatment with other antisense compounds.

In general, cells are treated with antisense oligonucleotides when the cells reach approximately 60-80% confluency in culture.

One reagent commonly used to introduce antisense oligonucleotides into cultured cells includes the cationic lipid transfection reagent LIPOFECTIN® (Invitrogen, Carlsbad, Calif.). Antisense oligonucleotides are mixed with LIPOFECTIN® in OPTI-MEM® 1 (Invitrogen, Carlsbad, Calif.) to achieve the desired final concentration of antisense oligonucleotide and a LIPOFECTIN® concentration that typically ranges 2 to 12 μg/mL per 100 nM antisense oligonucleotide.

Another reagent used to introduce antisense oligonucleotides into cultured cells includes LIPOFECTAMINE® (Invitrogen, Carlsbad, Calif.). Antisense oligonucleotide is mixed with LIPOFECTAMINE® in OPTI-MEM® 1 reduced serum medium (Invitrogen, Carlsbad, Calif.) to achieve the desired concentration of antisense oligonucleotide and a LIPOFECTAMINE® concentration that typically ranges 2 to 12 μg/μL per 100 nM antisense oligonucleotide.

Cells are treated with antisense oligonucleotides by routine methods. Cells are typically harvested 16-24 hours after antisense oligonucleotide treatment, at which time RNA or protein levels of target nucleic acids are measured by methods known in the art and described herein. In general, when treatments are performed in multiple replicates, the data are presented as the average of the replicate treatments.

The concentration of antisense oligonucleotide used varies from cell line to cell line. Methods to determine the optimal antisense oligonucleotide concentration for a particular cell line are well known in the art. Antisense oligonucleotides are typically used at concentrations ranging from 1 nM to 300 nM.

RNA Isolation

RNA analysis can be performed on total cellular RNA or poly(A)+ mRNA. Methods of RNA isolation are well known in the art. RNA is prepared using methods well known in the art, for example, using the TRIZOL® Reagent (Invitrogen, Carlsbad, Calif.) according to the manufacturer's recommended protocols.

Analysis of Inhibition of Target Levels or Expression

Inhibition of levels or expression of a SMRT nucleic acid can be assayed in a variety of ways known in the art. For example, target nucleic acid levels can be quantitated by, e.g., Northern blot analysis, competitive polymerase chain reaction (PCR), or quantitaive real-time PCR. RNA analysis can be performed on total cellular RNA or poly(A)+ mRNA. Methods of RNA isolation are well known in the art. Northern blot analysis is also routine in the art. Quantitative real-time PCR can be conveniently accomplished using the commercially available ABI PRISM® 7600, 7700, or 7900 Sequence Detection System, available from PE-Applied Biosystems, Foster City, Calif. and used according to manufacturer's instructions.

Quantitative Real-Time PCR Analysis of Target RNA Levels

Quantitation of target RNA levels may be accomplished by quantitative real-time PCR using the ABI PRISM® 7600, 7700, or 7900 Sequence Detection System (PE-Applied Biosystems, Foster City, Calif.) according to manufacturer's instructions. Methods of quantitative real-time PCR are well known in the art.

Prior to real-time PCR, the isolated RNA is subjected to a reverse transcriptase (RT) reaction, which produces complementary DNA (cDNA) that is then used as the substrate for the real-time PCR amplification. The RT and real-time PCR reactions are performed sequentially in the same sample well. RT and real-time PCR reagents are obtained from Invitrogen (Carlsbad, Calif.). RT, real-time-PCR reactions are carried out by methods well known to those skilled in the art.

Gene (or RNA) target quantities obtained by real time PCR are normalized using either the expression level of a gene whose expression is constant, such as cyclophilin A, or by quantifying total RNA using RIBOGREEN® (Invitrogen, Inc. Carlsbad, Calif.). Cyclophilin A expression is quantified by real time PCR, by being run simultaneously with the target, multiplexing, or separately. Total RNA is quantified using RIBOGREEN® RNA quantification reagent (Invetrogen, Inc. Eugene, Oreg.). Methods of RNA quantification by RIBOGREEN® are taught in Jones, L. J., et al, (Analytical Biochemistry, 1998, 265, 368-374). A CYTOFLUOR® 4000 instrument (PE Applied Biosystems) is used to measure RIBOGREEN® fluorescence.

Probes and primers are designed to hybridize to a SMRT nucleic acid. Methods for designing real-time PCR probes and primers are well known in the art, and may include the use of software such as PRIMER EXPRESS® Software (Applied Biosystems, Foster City, Calif.).

Analysis of Protein Levels

Antisense inhibition of SMRT nucleic acids can be assessed by measuring SMRT protein levels. Protein levels of SMRT can be evaluated or quantitated in a variety of ways well known in the art, such as immunoprecipitation, Western blot analysis (immunoblotting), enzyme-linked immunosorbent assay (ELISA), quantitative protein assays, protein activity assays (for example, histone deacytelase activity), immunohistochemistry, immunocytochemistry or fluorescence-activated cell sorting (FACS). Antibodies directed to a target can be identified and obtained from a variety of sources, such as the MSRS catalog of antibodies (Aerie Corporation, Birmingham, Mich.), or can be prepared via conventional monoclonal or polyclonal antibody generation methods well known in the art.

In vivo Testing of Antisense Compounds

Antisense compounds, for example, antisense oligonucleotides, are tested in animals to assess their ability to inhibit expression of SMRT and produce phenotypic changes, such as decreased plasma glucose, plasma triglycerides, plasma cholesterol, and body weight. Testing may be performed in normal animals, or in experimental disease models. For administration to animals, antisense oligonucleotides are formulated in a pharmaceutically acceptable diluent, such as phosphate-buffered saline. Administration includes parenteral routes of administration, such as intraperitoneal, intravenous, and subcutaneous. Calculation of antisense oligonucleotide dosage and dosing frequency is within the abilities of those skilled in the art, and depends upon factors such as route of administration and animal body weight. Following a period of treatment with antisense oligonucleotides, RNA is isolated from liver tissue and changes in SMRT nucleic acid expression are measured.

Certain Indications

In certain embodiments, the invention provides methods of treating an individual comprising administering one or more pharmaceutical compositions of the present invention. In certain embodiments, the individual has a metabolic disorder. In certain embodiments, the metabolic disorder is obesity, diabetes, dyslipidemia, or hypertension.

In certain embodiments, administration of a therapeutically effective amount of an antisense compound targeted to a SMRT nucleic acid is accompanied by monitoring plasma glucose, plasma triglycerides, and plasma cholesterol levels in the serum of an individual, to determine an individual's response to administration of the antisense compound. In certain embodiments, body weight is monitored. In certain embodiments, thyroid-stimulating hormone (TSH), triiodothyronine (T3), and thyroxine (T4) are monitored. An individual's response to administration of the antisense compound is used by a physician to determine the amount and duration of therapeutic intervention.

In certain embodiments, administration of an antisense compound targeted to a SMRT nucleic acid results in reduction of SMRT expression by at least 15, 20, 25, 30, 35, 40, 45, 50, 55, 60, 65, 70, 75, 80, 85, 90, 95 or 99%, or a range defined by any two of these values. In certain embodiments, administration of an antisense compound targeted to a SMRT nucleic acid results in a change in plasma glucose, plasma triglycerides, plasma cholesterol, and/or body weight. In certain embodiments, administration of a SMRT antisense compound decreases plasma glucose, plasma triglycerides, plasma cholesterol, and/or body weight by at least 15, 20, 25, 30, 35, 40, 45, or 50%, or a range defined by any two of these values.

In certain embodiments a pharmaceutical composition comprising an antisense compound targeted to SMRT is used for the preparation of a medicament for treating a patient suffering or susceptible to a metabolic disorder.

Certain Combination Therapies

In certain embodiments, one or more pharmaceutical compositions of the present invention are co-administered with one or more other pharmaceutical agents. In certain embodiments, such one or more other pharmaceutical agents are designed to treat the same disease or condition as the one or more pharmaceutical compositions of the present invention. In certain embodiments, such one or more other pharmaceutical agents are designed to treat a different disease or condition as the one or more pharmaceutical compositions of the present invention. In certain embodiments, such one or more other pharmaceutical agents are designed to treat an undesired effect of one or more pharmaceutical compositions of the present invention. In certain embodiments, one or more pharmaceutical compositions of the present invention are co-administered with another pharmaceutical agent to treat an undesired effect of that other pharmaceutical agent. In certain embodiments, one or more pharmaceutical compositions of the present invention and one or more other pharmaceutical agents are administered at the same time. In certain embodiments, one or more pharmaceutical compositions of the present invention and one or more other pharmaceutical agents are administered at different times. In certain embodiments, one or more pharmaceutical compositions of the present invention and one or more other pharmaceutical agents are prepared together in a single formulation. In certain embodiments, one or more pharmaceutical compositions of the present invention and one or more other pharmaceutical agents are prepared separately.

In certain embodiments, the additional therapy or therapeutic agent that may be co-administered with a pharmaceutical composition of the present invention, includes thyroid-stimulating hormone (TSH) supplementation, triiodothyronine (T3) supplementation, and/or thyroxine (T4) supplementation In certain embodiments, pharmaceutical agents that may be co-administered with a pharmaceutical composition of the present invention include glucose-lowering agents, lipid lowering agents, and weight modulating agents.

In certain embodiments, the glucose-lowering agent is a PPAR agonist (gamma, dual, or pan), a dipeptidyl peptidase (IV) inhibitor, a GLP-1 analog, insulin or an insulin analog, an insulin secretagogue, a SGLT2 inhibitor, a human amylin analog, a biguanide, an alpha-glucosidase inhibitor, a meglitinide, a thiazolidinedione, or a sulfonylurea.

In certain embodiments, the GLP-1 analog is exendin-4 or liraglutide.

In certain embodiments, the biguanide is metformin. In certain embodiments, blood glucose levels are decreased without increased lactic acidosis as compared to the lactic acidosis observed after treatment with metformin alone.

In certain embodiments, the alpha-glucosidase inhibitor is acarbose or miglitol.

In certain embodiments, the meglitinide is nateglinide or repaglinide.

In certain embodiments, the thiazolidinedione is pioglitazone, rosiglitazone, or troglitazone. In certain embodiments, blood glucose levels are decreased without greater weight gain than observed with rosiglitazone treatment alone.

In certain embodiments, sulfonylurea may be any of acetohexamide, chlorpropamide, tolbutamide, tolazamide, glimepiride, a glipizide, a glyburide, or a gliclazide.

In certain embodiments, the lipid-lowering agent is an HMG-CoA reductase inhibitor, a cholesterol absorption inhibitor, a microsomal triglyceride transfer protein inhibitor (MTP inhibitor), a nicotinic acid, or a fibric acid.

In certain embodiments, the HMG-CoA reductase inhibitor is a statin. In certain such embodiments, the statin is selected from atorvastatin, simvastatin, pravastatin, fluvastatin, and rosuvastatin.

In certain embodiments, the cholesterol absorption inhibitor is ezetimibe.

In certain embodiments, the nicotinic acid is immediate release nicotinic acid, extended release nicotinic acid, or sustained release nicotinic acid.

In certain embodiments, the fibric acid is gemfibrozil, fenofibrate, clofibrate, bezafibrate, or ciprofibrate.

In certain embodiments, a lipid-lowering agent is an oligonucleotide targeted to ApoB In certain embodiments, SMRT-specific modulators or inhibitors may be administered at the same time or at different times with combined additional therapies or therapeutic agents. Examples of combined additional therapies or therapeutic agents that can be administered with a SMRT-specific modulator or inhibitor include, without limitation, Avandamet (GlaxoSmithKline) a combination of Rosiglitazone and Metformin, Glucovance (Bristol-Myers Squibb) a combination of Metformin and Glyburide, Metaglip (Bristol-Myers Squibb) a combination of Metformin and Glipizide, Duetact (Takeda) a combination of Pioglitazone and Glimepirid, Janumet (Merck) a combination of Sitagliptin and Metformin HCl, or ACTOplus met (Takeda) a combination of Metformin and pioglitazone.

In certain embodiments, the second compound is administered prior to administration of a pharmaceutical composition of the present invention. In certain embodiments, the second compound is administered following administration of a pharmaceutical composition of the present invention. In certain embodiments, the second compound is administered at the same time as a pharmaceutical composition of the present invention. In certain embodiments, the dose of a co-administered second compound is the same as the dose that would be administered if the second compound was administered alone. In certain embodiments, the dose of a co-administered second compound is lower than the dose that would be administered if the second compound was administered alone. In certain embodiments, the dose of a co-administered second compound is greater than the dose that would be administered if the second compound was administered alone.

In certain embodiments, the co-administration of a second compound enhances the effect of a first compound, such that co-administration of the compounds results in an effect that is greater than the effect of administering the first compound alone. In certain embodiments, the co-administration results in effects that are additive of the effects of the compounds when administered alone. In certain embodiments, the co-administration results in effects that are supra-additive of the effects of the compounds when administered alone In certain embodiments, the first compound is an antisense compound. In certain embodiments, the second compound is an antisense compound.

EXAMPLES

Nonlimiting Disclosure and Incorporation by Reference

While certain compounds, compositions and methods described herein have been described with specificity in accordance with certain embodiments, the following examples serve only to illustrate the compounds described herein and are not intended to limit the same. Each of the references recited in the present application is incorporated herein by reference in its entirety.

The in vivo studies provided herein below are carried out in well characterized models of disease that are recognized by those of skill in the art as being predictive of therapeutic results in other animals, including humans.

Example 1

Antisense Inhibition of Human SMRT: A549 Cells

The A549 cell line is a well characterized human cell line known to express SMRT and is therefore useful for assessing the effectiveness of antisense oligonucleotides for inhibiting SMRT.

In accordance with the present invention, a series of oligonucleotides were designed to target different regions of the human SMRT RNA, using published sequences (GenBank accession number AF125672.1, incorporated herein as SEQ ID NO: 1; GenBank accession number NM_006312.1, incorporated herein as SEQ ID NO: 2; and the complement of residues 39001-260000 of GenBank accession number NT_009459.3, representing a partial genomic sequence of SMRT, incorporated herein as SEQ ID NO: 3. The oligonucleotides are shown in Table 1. "Target site" indicates the first (5'-most) nucleotide number on the particular target sequence to which the oligonucleotide binds. All compounds in Table 1 are chimeric oligonucleotides ("gapmers") 20 nucleotides in length, composed of a central "gap" region consisting of ten 2'-deoxynucleotides, which is flanked on both sides (5' and 3' directions) by five-nucleotide "wings". The wings are composed of 2'-methoxyethyl (2'-MOE) nucleotides. The internucleoside (backbone) linkages are phosphorothioate (P=S) throughout the oligonucleotide. All cytidine residues are 5-methylcytidines.

The compounds were analyzed for their effect on human SMRT mRNA levels by quantitative real-time PCR. Data are averages from two experiments in which A549 cells were treated with the antisense oligonucleotides of the present invention.

It is expected that the relative inhibition levels of antisense oligonucleotides in vitro will be consistent across cell types which express an mRNA with which the antisense oligonucleotides are specifically hybridizable. This is also expected in vivo for cells to which the antisense oligonucleotides distribute.

TABLE 1

Inhibition of SMRT mRNA levels by chimeric oligonucleotides having 5-10-5 MOE wings and deoxy gap

| ISIS # | REGION | TARGET SEQ ID NO | TARGET SITE | SEQUENCE | % INHIB | SEQ ID NO |
|---|---|---|---|---|---|---|
| 121624 | 5'UTR | 1 | 61 | agtcctcgtcatcagctcac | 13 | 5 |
| 152703 | Coding | 2 | 2705 | ctcttggcagtggtggccct | 63 | 6 |
| 152708 | Coding | 2 | 6987 | atgttcctgcaccgcctggc | 82 | 7 |
| 195343 | 5'UTR | 1 | 10 | ctccagcgaggctgtgtcct | 77 | 8 |
| 195344 | 5'UTR | 1 | 30 | tcactggcaccagaaactgc | 32 | 9 |
| 195345 | Start Codon | 1 | 150 | tggagcccgacatggtggtg | 27 | 10 |
| 195346 | Coding | 1 | 635 | ccgtggcggcaccagctcca | 63 | 11 |
| 195347 | Coding | 1 | 1203 | gctggcccaccctctgcatg | 70 | 12 |
| 195348 | Coding | 1 | 1856 | gctgttggcagttttgcggc | 21 | 13 |
| 195349 | Coding | 1 | 2311 | ttgacagtggcttcagcctc | 24 | 14 |
| 195350 | Coding | 1 | 3194 | aggcttctctgcctccttgt | 49 | 15 |
| 195351 | Coding | 1 | 3752 | tgtgctgggaatgcctttgg | 75 | 16 |
| 195352 | Coding | 1 | 5930 | ctccttgggcagcaagacgg | 73 | 17 |
| 195353 | Coding | 1 | 7307 | gccgccacctggcgaggtga | 52 | 18 |
| 195354 | Stop Codon | 1 | 7670 | tgttctgagtcactcgctgt | 57 | 19 |
| 195355 | 3'UTR | 1 | 8323 | catcatttacatctgccttt | 39 | 20 |
| 195356 | Coding | 2 | 1048 | ggcccaccctgctctgcatg | 69 | 21 |
| 195357 | Coding | 2 | 2159 | gcatgtaaggcttcagcctc | 0 | 22 |
| 195358 | Coding | 2 | 2172 | ctcattcccagaggcatgta | 76 | 23 |
| 195359 | Coding | 2 | 2210 | ttgacagtggctgggccact | 38 | 24 |
| 195360 | Coding | 2 | 3092 | gctgcgaaggcctccttgtc | 48 | 25 |

TABLE 1-continued

Inhibition of SMRT mRNA levels by chimeric oligonucleotides having 5-10-5 MOE wings and deoxy gap

| ISIS # | REGION | TARGET SEQ ID NO | TARGET SITE | SEQUENCE | % INHIB | SEQ ID NO |
|---|---|---|---|---|---|---|
| 195361 | Exon: Intron Junction | 3 | 926 | atgaacctaccagaaactgc | 33 | 26 |
| 195362 | Intron | 3 | 5600 | accagacaaggctctgggct | 38 | 27 |
| 195363 | Intron: Exon Junction | 3 | 41188 | tcactggcacctgcgggaaa | 30 | 28 |
| 195364 | Exon: Intron Junction | 3 | 41410 | accccttaccgtgtgcgtc | 31 | 29 |
| 195365 | Intron | 3 | 72430 | cccagtgtcctgaattccta | 51 | 30 |
| 195366 | Intron: Exon Junction | 3 | 82830 | cagccttcttctgcagggtg | 34 | 31 |
| 195367 | Intron: Exon Junction | 3 | 110566 | cgctggcccaccctgctggg | 48 | 32 |
| 195368 | Intron | 3 | 121997 | gaccgagttcagccccaggc | 30 | 33 |
| 195369 | Intron: Exon Junction | 3 | 166452 | gcatgtaaggctggaaggaa | 68 | 34 |
| 195370 | Exon: Intron Junction | 3 | 166503 | acattcgtacctgggccact | 66 | 35 |
| 195371 | Intron: Exon Junction | 3 | 184109 | ggcttctctgctgagggcag |  | 36 |
| 195372 | Intron: Exon Junction | 2 | 3268 | gctgcgaaggctgggaagaa | 68 | 37 |
| 195373 | Intron | 3 | 195790 | cacttgttacttactgccct | 63 | 38 |
| 195374 | Exon: Intron Junction | 2 | 7222 | tcatatttacccatgagtgc | 63 | 39 |
| 195375 | Exon: Intron Junction | 3 | 217330 | ggcctgcagacctggcgagg | 62 | 40 |
| 195376 | Coding | 3 | 2392 | gccgccacccatgagtgcct | 72 | 41 |

Example 2

Antisense Inhibition of Mouse SMRT: b.END Cells

Antisense oligonucleotides targeted to a SMRT nucleic acid were tested for their effects on SMRT mRNA in vitro. Cultured b.END cells were transfected using lipofectin reagent with 90 nM antisense oligonucleotide for 4 hours. After a recovery period of approximately 24 hours, RNA was isolated from the cells and SMRT mRNA levels were measured by quantitative real-time PCR. SMRT mRNA levels were adjusted according to total RNA content, as measured by RIBOGREEN®. Results are presented as percent inhibition of SMRT, relative to untreated control cells.

The chimeric antisense oligonucleotides in Table 2 were designed as 5-10-5 MOE gapmers. The gapmers are 20 nucleotides in length, wherein the central gap segment is comprised of 10 2'-deoxynucleotides and is flanked on both sides (in the 5' and 3' directions) by wings comprising 5 nucleotides each. Each nucleotide in the 5' wing segment and each nucleotide in the 3' wing segment has a 2'-MOE modification. The internucleoside linkages throughout each gapmer are phosphorothioate (P=S) linkages. All cytidine residues throughout each gapmer are 5-methylcytidines. "Mouse target start site" indicates the 5'-most nucleotide to which the gapmer is targeted in the mouse sequence. "Mouse target stop site" indicates the 3'-most nucleotide to which the gapmer is targeted in the mouse sequence. Each gapmer listed in Table 2 is targeted to mouse target sequence (GenBank accession number NM_011424.1, incorporated herein as SEQ ID NO: 120; or GenBank accession number NT_039313.6, which is the complementary sequence of the gene truncated from nucleotides 306000 to 471000, incorporated herein as SEQ ID NO: 121; or GenBank accession number AF113001.1, incorporated herein as SEQ ID NO: 122, or GENBANK Accession No. AK170097.1, incorporated herein as SEQ ID NO: 123.

The mouse oligonucleotides also show cross reactivity, (i.e. ≦3 base mismatch) with the human SMRT mRNA (GENBANK Accession No. NM_006312.1), incorporated herein as SEQ ID NO: 2. "Human Target Start Site" indicates the 5'-most nucleotide in the human mRNA to which the antisense oligonucleotide is targeted. "Human Target Stop Site" indicates the 3'-most nucleotide in the human mRNA to which the antisense oligonucleotide is targeted. 'Mismatches' indicates the number of nucleobases by which the mouse oligonucleotide is mismatched with the human gene sequence. 'n/a' indicates that there was no cross-reactivity between the mouse oligonucleotide and the human gene sequence.

TABLE 2

Inhibition of mouse SMRT mRNA levels by chimeric antisense oligonucleotides having 5-10-5 MOE wings and deoxy gap

| ISIS No. | Mouse Target Start Site | Mouse Target Stop Site | Sequence (5' to 3') | % inhibition | Human Target Start Site | Human Target Stop Site | Mis-matches | Mouse Target Sequence | SEQ ID NO |
|---|---|---|---|---|---|---|---|---|---|
| 400765 | 125 | 144 | GTAGGCTTTGGAGCCAAGAC | 6 | n/a | n/a | n/a | NM_011424.1 | 42 |
| 400766 | 430 | 449 | TTGCCCAGCTCAGGCAGGAA | 31 | 272 | 291 | 3 | NM_011421.1 | 43 |
| 400767 | 550 | 569 | TTGGTAAGGTCTTCAGACCC | 31 | 392 | 411 | 2 | NM_011424.1 | 44 |
| 400768 | 953 | 972 | GATGTTTTCATGGTACTGGC | 11 | 792 | 811 | 3 | NM_011424.1 | 45 |
| 400769 | 997 | 1016 | TTAAAGTACAAGATCAGCTT | 45 | 836 | 855 | 2 | NM_011424.1 | 46 |
| 400770 | 1280 | 1299 | CAAGCCATCAATGATCTCAG | 16 | n/a | n/a | n/a | NM_011424.1 | 47 |
| 400771 | 1285 | 1304 | TCAGACAAGCCATCAATGAT | 3 | n/a | n/a | n/a | NM_011424.1 | 48 |
| 400772 | 1392 | 1411 | CATCCATGAGTCCATTCATG | 40 | n/a | n/a | n/a | NM_011424.1 | 49 |
| 400773 | 1506 | 1525 | AGGCAATCAGGCCAAAGTTC | 37 | 1348 | 1367 | 2 | NM_011424.1 | 50 |
| 400774 | 1516 | 1535 | TCCAGGAATGAGGCAATCAG | 21 | 1358 | 1377 | 2 | NM_011424.1 | 51 |
| 400775 | 1549 | 1568 | TAATAGAGGACACACTCAGC | 45 | 1391 | 1410 | 1 | NM_011424.1 | 52 |
| 400776 | 1558 | 1577 | GTCAGGTAGTAATAGAGGAC | 41 | 1400 | 1419 | 0 | NM_011424.1 | 53 |
| 400777 | 2043 | 2062 | GGGCAATGGCTGACCAGTTC | 44 | 1897 | 1916 | 3 | NM_011424.1 | 54 |
| 400778 | 2091 | 2110 | TGAAGTAGAAGTTCTTACAC | 6 | 1945 | 1964 | 0 | NM_011424.1 | 55 |
| 400779 | 2325 | 2344 | TGGGAACCTCATTCCCAGAG | 20 | 2179 | 2198 | 1 | NM_011424.1 | 56 |

TABLE 2-continued

Inhibition of mouse SMRT mRNA levels by chimeric antisense oligonucleotides having 5-10-5 MOE wings and deoxy gap

| ISIS No. | Mouse Target Start Site | Mouse Target Stop Site | Sequence (5' to 3') | % inhibition | Human Target Start Site | Human Target Stop Site | Mis-matches | Mouse Target Sequence | SEQ ID NO |
|---|---|---|---|---|---|---|---|---|---|
| 400780 | 2430 | 2449 | TGGGTTTAGGCCCAGTGTCC | 23 | n/a | n/a | n/a | NM_011424.1 | 57 |
| 400781 | 2441 | 2460 | TTCAGTGCCAGTGGGTTTAG | 28 | n/a | n/a | n/a | NM_011424.1 | 58 |
| 400782 | 2447 | 2466 | CAATGCTTCAGTGCCAGTGG | 58 | n/a | n/a | n/a | NM_011424.1 | 59 |
| 400783 | 2802 | 2821 | CAGACACAGTTTCAATGGCC | 56 | n/a | n/a | n/a | NM_011424.1 | 60 |
| 400784 | 2815 | 2834 | TTAAGTGGTGCCTCAGACAC | 22 | n/a | n/a | n/a | NM_011424.1 | 61 |
| 400785 | 3037 | 3056 | TTCAGCTGCTTCAGGTCCAG | 39 | 2882 | 2901 | 0 | NM_011424.1 | 62 |
| 400786 | 3354 | 3373 | GTGTGGAAGTCTTGATCACC | 0 | n/a | n/a | n/a | NM_011424.1 | 63 |
| 400787 | 3378 | 3397 | TGTAGGAGAAGAGAGGGTCA | 0 | n/a | n/a | n/a | NM_011424.1 | 64 |
| 400788 | 3525 | 3544 | CCTGGGAGATGGCACCCAGC | 16 | n/a | n/a | n/a | NM_011424.1 | 65 |
| 400789 | 4285 | 4304 | TTCACAGTTGCTACCACACC | 45 | n/a | n/a | n/a | NM_011424.1 | 66 |
| 400790 | 4430 | 4449 | GCCAGTGGAGGGTGCCCCAG | 77 | n/a | n/a | n/a | NM_011424.1 | 67 |
| 400791 | 4438 | 4457 | TTCTTGGTGCCAGTGGAGGG | 43 | n/a | n/a | n/a | NM_011424.1 | 68 |
| 400792 | 4796 | 4815 | GGGTGTAGATGTCAGCTTCC | 49 | n/a | n/a | n/a | NM_011424.1 | 69 |
| 400793 | 4923 | 4942 | AGGCCAATGGGATGTGACCA | 51 | n/a | n/a | n/a | NM_011424.1 | 70 |
| 400794 | 5100 | 5119 | TGTAGTCATTGATGATGGTC | 38 | 5050 | 5069 | 0 | NM_011424.1 | 71 |
| 400795 | 5107 | 5126 | GAGGTGATGTAGTCATTGAT | 31 | 5057 | 5076 | 0 | NM_011424.1 | 72 |

TABLE 2-continued

Inhibition of mouse SMRT mRNA levels by chimeric antisense oligonucleotides having 5-10-5 MOE wings and deoxy gap

| ISIS No. | Mouse Target Start Site | Mouse Target Stop Site | Sequence (5' to 3') | % inhibition | Human Target Start Site | Human Target Stop Site | Mis-matches | Mouse Target Sequence | SEQ ID NO |
|---|---|---|---|---|---|---|---|---|---|
| 400796 | 5171 | 5190 | CAGACCCCTCAGCATGTCAG | 55 | 5121 | 5140 | 3 | NM_011424.1 | 73 |
| 400797 | 5248 | 5267 | TGTGGCACTTGGGACAGGTC | 71 | 5198 | 5217 | 0 | NM_011424.1 | 74 |
| 400798 | 5408 | 5427 | AGATGTGGCAGTTGGTTTAG | 22 | n/a | n/a | n/a | NM_011424.1 | 75 |
| 400799 | 5691 | 5710 | TGGAGGTGGACCTCAGGACC | 23 | 5689 | 5708 | 0 | NM_011424.1 | 76 |
| 400800 | 5761 | 5780 | TCAAGGGTGCCACCAAGTGG | 22 | 5759 | 5778 | 3 | NM_011424.1 | 77 |
| 400801 | 6064 | 6083 | AAGGGTTTACTTTGAGTCTT | 41 | 6074 | 6093 | 0 | NM_011424.1 | 78 |
| 400802 | 6070 | 6089 | ATGGAAAAGGGTTTACTTTG | 24 | 6080 | 6099 | 0 | NM_011424.1 | 79 |
| 400803 | 6077 | 6096 | TTCCTGGATGGAAAAGGGTT | 14 | 6087 | 6106 | 0 | NM_011424.1 | 80 |
| 400804 | 6194 | 6213 | AGGTTTGGAGAGCCCCTTGT | 29 | n/a | n/a | n/a | NM_011424.1 | 81 |
| 400805 | 6200 | 6219 | TTCCAGAGGTTTGGAGAGCC | 10 | n/a | n/a | n/a | NM_011424.1 | 82 |
| 400806 | 6387 | 6406 | GCTGAGCCAGGGTGACCACC | 63 | 6394 | 6413 | 1 | NM_011424.1 | 83 |
| 400807 | 6504 | 6523 | GAAGATCCAGCACAGGGCAG | 0 | n/a | n/a | n/a | NM_011424.1 | 84 |
| 400808 | 6652 | 6671 | GACACAGGCTCAATGGCATC | 48 | n/a | n/a | n/a | NM_011424.1 | 85 |
| 400809 | 6713 | 6732 | ATACAGCAGTGGGTACACAG | 35 | 6720 | 6739 | 2 | NM_011424.1 | 86 |
| 400810 | 6772 | 6791 | TGGCTGGTGTTGCCTGGAGA | 56 | 6782 | 6801 | 0 | NM_011424.1 | 87 |

TABLE 2-continued

Inhibition of mouse SMRT mRNA levels by chimeric antisense oligonucleotides having 5-10-5 MOE wings and deoxy gap

| ISIS No. | Mouse Target Start Site | Mouse Target Stop Site | Sequence (5' to 3') | % inhibition | Human Target Start Site | Human Target Stop Site | Mis-matches | Mouse Target Sequence | SEQ ID NO |
|---|---|---|---|---|---|---|---|---|---|
| 400811 | 6997 | 7016 | AGCCCCATGTTGGTGCTGGC | 24 | 7007 | 7026 | 0 | NM_011424.1 | 88 |
| 400812 | 7031 | 7050 | TTTACCCATGAGTGCCTTTC | 42 | 7041 | 7060 | 0 | NM_011424.1 | 89 |
| 400813 | 7084 | 7103 | AGAGGGTTAAAAGCATTGGC | 0 | 7094 | 7113 | 0 | NM_011424.1 | 90 |
| 400814 | 7093 | 7112 | CTGGCATTCAGAGGGTTAAA | 10 | 7103 | 7122 | 0 | NM_011424.1 | 91 |
| 400815 | 7128 | 7147 | TGGTTATGGGCATAGCAGCA | 9 | 7135 | 7154 | 2 | NM_011424.1 | 92 |
| 400816 | 7201 | 7220 | GGTCTGCCAGAGACCTTGGC | 31 | 7208 | 7227 | 0 | NM_011424.1 | 93 |
| 400817 | 7712 | 7731 | GTTAAGGCTTTAGACAGGCA | 52 | 7714 | 7733 | 0 | NM_011424.1 | 94 |
| 400818 | 7722 | 7741 | GGGAGTCTTAGTTAAGGCTT | 43 | 7724 | 7743 | 0 | NM_011424.1 | 95 |
| 400819 | 7778 | 7797 | AGCACCAGGTAAACATCCCC | 28 | 7776 | 7795 | 0 | NM_011424.1 | 96 |
| 400820 | 7947 | 7966 | TTAGACTTTGGTTCCAAATG | 76 | 7926 | 7945 | 0 | NM_011424.1 | 97 |
| 400821 | 8043 | 8062 | TGACAGCATTAGGGCAGGAT | 64 | n/a | n/a | n/a | NM_011424.1 | 98 |
| 400822 | 8124 | 8143 | CAGCCAGGCCCCTTGTGTCA | 0 | n/a | n/a | n/a | NM_011424.1 | 99 |
| 400823 | 8233 | 8252 | AGGTATCAAAAATATACCCT | 36 | 8229 | 8248 | 0 | NM_011424.1 | 100 |
| 400824 | 8310 | 8329 | TAGGTAGAGACCAAAGCACA | 47 | n/a | n/a | n/a | NM_011424.1 | 101 |
| 400825 | 8505 | 8524 | TGCTTTTTAATTGGAACAAC | 34 | 8512 | 8531 | 3 | NM_011424.1 | 102 |
| 400826 | 6881 | 6900 | TCAGTTCCCAGAGCAGAGA | 10 | n/a | n/a | n/a | NT_039313.6_TRUNC_30 | 103 |

TABLE 2-continued

Inhibition of mouse SMRT mRNA levels by chimeric antisense oligonucleotides having 5-10-5 MOE wings and deoxy gap

| ISIS No. | Mouse Target Start Site | Mouse Target Stop Site | Sequence (5' to 3') | % inhibition | Human Target Start Site | Human Target Stop Site | Mis-matches | Mouse Target Sequence | SEQ ID NO |
|---|---|---|---|---|---|---|---|---|---|
| | | | G | | | | | 6000_47 1000_CO MP | |
| 400827 | 37871 | 37890 | TTCAGCCAAGATGTAACCAC | 0 | n/a | n/a | n/a | NT_039313.6_TRUNC_306000_471000_COMP | 104 |
| 400828 | 38558 | 38577 | AGGAAGTTATGTGACCCAAA | 16 | n/a | n/a | n/a | NT_039313.6_TRUNC_306000_471000_COMP | 105 |
| 400829 | 84360 | 84379 | AGCCAAAGCCATCCAATGAG | 15 | n/a | n/a | n/a | NT_039313.6_TRUNC_306000_471000_COMP | 106 |
| 400830 | 94682 | 94701 | TGGCCCAGAGAGCAGAATGG | 0 | n/a | n/a | n/a | NT_039313.6_TRUNC_306000_471000_COMP | 107 |
| 400831 | 133107 | 133126 | CCATGGTAGGCAGGGCCACC | 53 | n/a | n/a | n/a | NT_039313.6_TRUNC_306000_471000_COMP | 108 |
| 400832 | 146986 | 147005 | CACACCATAAGGGAGGTACC | 0 | n/a | n/a | n/a | NT_039313.6_TRUNC_306000_471000_COMP | 109 |
| 400833 | 150285 | 150304 | TACAGGCCCAGGACACCCAC | 14 | n/a | n/a | n/a | NT_039313.6_TRUNC_306000_471000_COMP | 110 |
| 400834 | 158099 | 158118 | GGACACACAGGAGGGTTACC | 22 | n/a | n/a | n/a | NT_039313.6_TRUNC_306000_471000_COMP | 111 |
| 400835 | 6368 | 6387 | TTGGTAAGAAAGGCATGGCC | 4 | 5867 | 5886 | 3 | AF113001.1 | 112 |
| 400836 | 8201 | 8220 | TAGACAGGCAGAATGCCAGC | 28 | n/a | n/a | n/a | AF113001.1 | 113 |

TABLE 2-continued

Inhibition of mouse SMRT mRNA levels by chimeric antisense oligonucleotides having 5-10-5 MOE wings and deoxy gap

| ISIS No. | Mouse Target Start Site | Mouse Target Stop Site | Sequence (5' to 3') | % inhibition | Human Target Start Site | Human Target Stop Site | Mis-matches | Mouse Target Sequence | SEQ ID NO |
|---|---|---|---|---|---|---|---|---|---|
| 400837 | 70998 | 71017 | GTCCATGTTCTGGATCAGCT | 48 | 513 | 532 | 0 | NT_039313.6_TRUNC_306000_471000_COMP | 114 |
| 400838 | 143649 | 143668 | CAGCCCCATGGTGAGAGGGC | 0 | 3438 | 3457 | 1 | NT_039313.6_TRUNC_306000_471000_COMP | 115 |
| 400839 | 7779 | 7798 | GAGCACCAGGTAAACATCCC | 52 | 7777 | 7796 | 0 | NM_011424.1 | 116 |
| 400840 | 163698 | 163717 | AGTCCATTTTGCCCAAGGAA | 70 | 8433 | 8452 | 3 | NT_039313.6_TRUNC_306000_471000_COMP | 117 |
| 400841 | 122686 | 122705 | CCACCAAGCCACAAGAAATC | 12 | n/a | n/a | n/a | NT_039313.6_TRUNC_306000_471000_COMP | 118 |
| 400842 | 558 | 577 | CCCATGTTCCAGGAGGCATC | 31 | n/a | n/a | n/a | AK170097.1 | 119 |

Example 3

Dose-dependent Inhibition of Mouse SMRT in vitro

Inhibition of SMRT mRNA

Chimeric antisense oligonucleotide having 5-10-5 MOE wings and deoxy gap were designed to target mouse SMRT (GENBANK Accession No. AK147394.1), incorporated herein as SEQ ID NO: 4. The antisense oligonucleotides were evaluated for their ability to reduce SMRT mRNA in primary mouse hepatocytes.

Primary mouse hepatocytes were treated with increasing concentrations of antisense oligonucleotides, as shown in Table 3, for a period of 4 hours. RNA was isolated from the cells after 24 hours and SMRT mRNA levels were measured by quantitative real-time PCR, as described herein. Mouse SMRT primer probe set RTS2818 was used to measure mRNA levels. SMRT mRNA levels were adjusted according to total RNA content as measured by RIBOGREEN®. Several oligonucleotides exhibited dose-dependent reduction of murine SMRT mRNA levels.

TABLE 3

| | dose-dependent reduction of mouse SMRT mRNA levels | | | | | |
|---|---|---|---|---|---|---|
| | 4.688 nM | 9.375 nM | 18.75 nM | 37.5 nM | 75 nM | 150 nM |
| 400782 | 0 | 0 | 0 | 21 | 58 | 76 |
| 400783 | 0 | 0 | 0 | 18 | 47 | 66 |
| 400790 | 0 | 6 | 19 | 57 | 73 | 85 |
| 400796 | 0 | 0 | 0 | 1 | 27 | 48 |
| 400797 | 0 | 0 | 14 | 36 | 72 | 86 |
| 400806 | 0 | 0 | 4 | 30 | 66 | 73 |
| 400810 | 0 | 0 | 0 | 26 | 53 | 76 |
| 400820 | 0 | 0 | 3 | 34 | 67 | 87 |
| 400821 | 0 | 0 | 2 | 27 | 72 | 77 |
| 400840 | 17 | 10 | 35 | 63 | 82 | 89 |

Example 4

Antisense Inhibition of SMRT Levels in in vivo Studies in Lean Mice

ISIS 400840, incorporated herein as SEQ ID NO: 117, which demonstrated statistically significant dose-dependent inhibition in vitro, was evaluated for its ability to reduce murine SMRT mRNA in vivo.

Treatment

Normal male C57 BL/6 mice were maintained on a 12-hour light/dark cycle and fed ad libitum normal Purina mouse chow. Animals were acclimated for at least 7 days in the research facility before initiation of the experiment. Antisense oligonucleotides (ASOs) were prepared in buffered saline and sterilized by filtering through a 0.2 micron filter. Oligonucleotides were dissolved in 0.9% saline for injection.

The mice were divided into two treatment groups. The first group received subcutaneous injections of ISIS 400840 at a dose of 37.5 mg/kg twice per week for 4 weeks. The second group received subcutaneous injections of saline twice weekly for 4 weeks. The saline-injected group served as the control group to which the oligonucleotide-treated group was compared.

Inhibition of SMRT mRNA

Twenty four hours after the final dose, the animals were sacrificed and liver tissue was isolated. The tissue samples were immediately homogenized in RLT buffer containing β-mercaptoethanol. Total RNA was centrifuged over a cesium chloride gradient and the RNA pellet was resuspended in RNase-free water and purified further using an RNeasy mini RNA preparation kit. RNA expression analysis was conducted by quantitative real-time RT-PCR. Targeted mRNA was normalized to total RNA as determined by RIBOGREEN® fluorescence from the same RNA sample.

Liver RNA was isolated for real-time PCR analysis of SMRT. Treatment with ISIS 400840 reduced SMRT mRNA expression approximately 77%.

Effect on Sterol Regulatory Element Binding Protein 1c (SREBP1c)

SREBP1c is a master regulator of lipogenic gene expression in liver and adipose tissue. SREBP1c orchestrates fatty acid and glucose metabolism by mediating regulation of insulin-dependent gene expression. Chromatin immunoprecipitation (ChIP) is a useful technique for detecting protein—DNA interactions in living cells.

To determine mechanistically how SMRT mediates transcriptional gene knockdown in vivo, the Chromatin Immunoprecipitation (ChIP) assay was used to measure histone acetylation at the SREBP1c promoter. ChIP is a powerful tool for identifying proteins, including histone proteins and non-histone proteins, associated with specific regions of the genome by using specific antibodies that recognize a specific protein or a specific modification of a protein. The technique involves cross linking of proteins with DNA, fragmentation, and preparation of soluble chromatin followed by immunoprecipitation with an antibody recognizing the protein of interest. The segment of the genome associated with the protein is then identified by PCR amplification of the DNA in the immunoprecipitates.

Liver tissue taken from animals treated with ISIS 400840 exhibited a decrease in acetylated H3 Histone (Ace-H3) on the LXR response element (LXRE) of the SREBP1c promoter. Liver from saline treated mice did not show a decrease in Ace-H3 on the LXRE of the SREBP1c promoter. These data suggest that ASO inhibition of SMRT decreases transcription of SREBP1c. The downregulation of SREBP1c modulates lipogenic gene expression in liver and adipose tissue.

Effect on Liver Fatty Acid Synthase (FAS) mRNA Levels

FAS is the enzyme responsible for de novo synthesis of fatty acids. The effect of ISIS 400840 on these genes was evaluated by measuring mRNA expression in animals treated with ISIS 400840 relative to saline treated animals.

As a result of treatment with ISIS 400840, FAS was decreased about 67%. Downregulation of FAS by antisense inhibition of SMRT results in a decrease of fatty acid synthesis.

Effect on Plasma Triglycerides and Cholesterol Levels

ISIS 400840 was tested for its ability to affect lipid metabolism in the lean mouse model. Plasma triglycerides and cholesterol were measured on an Olympus analyzer (Olympus AU400, Olympus American Inc, Melville, N.Y.). Triglyceride and cholesterol concentrations are expressed as absolute concentration in mg/dL and are presented in Tables 4 and 5.

ISIS 400840 reduced plasma triglycerides by about 39% and plasma cholesterol by about 26% after 4 weeks of treatment. These data show that ASO inhibition of SMRT is an effective means for decreasing plasma triglycerides and cholesterol. Therefore, SMRT inhibitors may be useful for the treatment of hyperlipidemia.

TABLE 4

Effect of antisense oligonucleotides on plasma triglycerides (mg/dL)

|  | Week | 0 | 2 | 4 |
|---|---|---|---|---|
| Control | Saline | 162 | 133 | 154 |
| SMRT ASO | ISIS 400840 | 110 | 110 | 94 |

TABLE 5

Effect of antisense oligonucleotides on plasma cholesterol (mg/dL)

|  | Week | 0 | 2 | 4 |
|---|---|---|---|---|
| Control | Saline | 94 | 93 | 81 |
| SMRT ASO | ISIS 400840 | 85 | 71 | 60 |

Example 5

Antisense Inhibition of SMRT Levels in in vivo Studies in db/db Mouse Model

Db/db mice (BKS.Cg-m +/+ Lepr$^{db}$/J) are used as a standard mouse model for diabetes (Chen H et al., *Cell,* 84, 491-5). Mice homozygous for the diabetes spontaneous mutation (Lepr$^{db}$) become identifiably obese around 3 to 4 weeks of age. Hyperglycemia ensues at age 4 to 8 weeks. Homozygous mutant mice are polyphagic, polydipsic, and polyuric (Chua, et al., *Science* 271, 994-6). The course of the disease is markedly influenced by genetic background. A number of features are observed on the C57BL/6 background, including an uncontrolled rise in blood sugar, severe depletion of the insulin-producing beta-cells of the pancreatic islets, and death by 10 months of age. Exogenous insulin fails to control blood glucose levels and gluconeogenic enzyme activity increases. Peripheral neuropathy and myocardial disease are seen in C57BL/6-Lepr$^{db}$ homozygotes. Wound healing is delayed, and metabolic efficiency is increased.

Treatment

The db/db mice were divided into two treatment groups. One group received subcutaneous injections of ISIS 400840 at a dose of 25 mg/kg twice per week for 5 weeks. The second group received subcutaneous injections of saline twice weekly for 5 weeks.

After the 5 week treatment period the mice were sacrificed and SMRT mRNA levels were evaluated in liver and white adipose tissue. mRNA expression levels were quantified by real-time PCR. Relative to the saline control, ISIS 400840 inhibited SMRT mRNA expression by about 85% in the liver and about 30% in white adipose tissue.

Effect on Plasma Glucose Levels

The ability of ISIS 400840 to reduce plasma glucose levels was assessed in the db/db mouse model. Mice were injected subcutaneously with saline or ISIS 400840 at 25 mg/kg twice a week. Plasma glucose was monitored at 2 and 5 weeks as shown in Table 6. Plasma glucose was determined with a biochemistry analyzer (Olympus AU400, Olympus American Inc, Melville, N.Y.). ISIS 400840 reduced plasma glucose levels by about 12% after a 5 week treatment period.

These data show that ASO inhibition of SMRT is an effective means for reducing plasma glucose in a diabetes disease model. While not being bound by any one theory, it is hypothesized that plasma glucose is reduced by the downregulation of certain gluconeogenic genes such as Pepck or G6P and possibly by less well characterized mechanisms.

TABLE 6

Effect of antisense oligonucleotides on plasma glucose levels (mg/dL)

| Week | Saline | ISIS 400840 |
|---|---|---|
| 0 | 399 | 399 |
| 2 | 615 | 636 |
| 5 | 739 | 650 |

Effect on Plasma Triglyceride and Cholesterol Levels

ISIS 400840 was tested for its ability to affect lipid metabolism in db/db mice. Triglycerides and cholesterol were measured using the biochemistry analyzer (Olympus AU400, Olympus American Inc, Melville, N.Y.). The data, expressed as absolute concentration in mg/dL, are presented in Tables 7 and 8.

The data indicate that ISIS 400840 was effective at lowering triglyceride levels in these mice. Triglyceride levels were lowered by about 38% over a 5 week period (reduced from 262 mg/dL at baseline to 162 mg/dL at five weeks). Cholesterol levels were decreased by about 22% over a 5 week period (reduced from 222 mg/dL at baseline to 174 mg/dL at 5 weeks). This data shows that ASO inhibition of SMRT is an effective means for decreasing plasma triglycerides and cholesterol in a diabetes disease model. Therefore, inhibitors of SMRT are useful for the treatment of hyperlipidemia and with the additional reduction in glucose, inhibitors of SMRT are useful for hyperlipidemia particularly associated with T2DM.

TABLE 7

Effect of antisense oligonucleotides on plasma triglycerides (mg/dL)

| Week | Saline | ISIS 400840 |
|---|---|---|
| 0 | 135 | 122 |
| 2 | 249 | 234 |
| 5 | 262 | 162 |

TABLE 8

Effect of antisense oligonucleotides on plasma cholesterol (mg/dL)

| Week | Saline | ISIS 400840 |
|---|---|---|
| 0 | 148 | 147 |
| 2 | 198 | 161 |
| 5 | 222 | 174 |

Example 6

Antisense Inhibition of SMRT in the Diet-Induced Model of Obesity (DIO)

The C57BL/6 mouse strain is reported to be susceptible to hyperlipidemia-induced atherosclerotic plaque formation. To induce hyperlipidemia, these mice were fed a high-fat diet and used in the following studies to evaluate the effects of ISIS 400840 in a model of diet-induced obesity.

Treatment

Male C57BL/6 mice at 7 weeks of age were placed on a high-fat diet containing 60% calories from fat (Research Diet D12492, Research Diets Inc., New Brunswick, N.J.). The mice were divided into two treatment groups. One group received subcutaneous injections of ISIS 400840 at a dose of 25 mg/kg twice per week for 7 weeks. The second group received subcutaneous injections of saline twice weekly for 7 weeks. Saline-injected lean mice served as a control group.

Inhibition of SMRT mRNA

At the end of the seven week treatment period, the mice were sacrificed and SMRT mRNA expression was measured in liver and white adipose tissue (WAT) by real-time PCR.

The results shown in Table 9 are expressed as percent expression relative to saline-treated mice. The data show that ISIS 400840 inhibited SMRT expression by approximately 80% in the liver and by about 36% in the white adipose tissue.

TABLE 9

Percent reduction of SMRT mRNA in ASO treated mice relative to saline treated mice

| | Saline | ISIS 400840 |
|---|---|---|
| liver | 0 | 20 |
| WAT | 0 | 64 |

Effect on Food Intake Levels

The accumulated food intake of the animals was monitored over 6 weeks. The results are shown in Table 10 and indicate that ISIS 400840 did not have a significant impact on amount of food consumed by the mice.

TABLE 10

Effect of antisense oligonucleotides on food intake in DIO mice (g)

| Week | saline | ISIS 400840 |
|---|---|---|
| 1 | 56 | 60 |
| 2 | 112 | 120 |
| 3 | 166 | 175 |
| 4 | 216 | 220 |
| 5 | 268 | 270 |
| 6 | 318 | 314 |

Effect on serum Cholesterol and Plasma Lipid Levels

Blood was obtained and analyzed for serum cholesterol and plasma lipids. Measurements were taken at baseline, 3 weeks, 5 weeks and 7 weeks.

The data indicate that administration of ISIS 400840, relative to the saline treated control, effectively reduces triglyceride and cholesterol levels (Tables 11 and 12). At 7 weeks, triglycerides levels are reduced by about 43% (from 107 mg/dL to 61 mg/dL) and cholesterol levels were reduced by about 44% (from 238 mg/dL to 133 mg/dL). This data shows that ASO inhibition of SMRT is an effective means for decreasing plasma triglycerides and cholesterol in a diet-induced obesity model. Therefore, inhibitors of SMRT are useful for the treatment of hyperlipidemia associated with dysregulated metabolic states such as obesity.

TABLE 11

Effect of antisense oligonucleotides on plasma triglyceride levels (mg/dL)

| Week | saline | ISIS 400840 |
|---|---|---|
| 0 fed | 107 | 105 |
| 3 fed | 98 | 76 |
| 5 fed | 102 | 71 |
| 6 overnight fasted | 84 | No data |
| 7 fed | 107 | 61 |

TABLE 12

Effect of antisense oligonucleotides on plasma cholesterol levels (mg/dL)

| Week | Saline | ISIS 400840 |
|---|---|---|
| 0 fed | 258 | 264 |
| 3 fed | 262 | 204 |
| 5 fed | 254 | 146 |
| 6 overnight fasted | 244 | No data |
| 7 fed | 238 | 133 |

Effect on Total Body Weight

Treatment of mice with ISIS 400840 resulted in a decrease in body weight, with animals losing an average of 9 grams over a period of 7 weeks, which was a significant reduction compared to control animals. The weekly measurements of body weights of the various treatment groups are shown in Table 13.

ISIS 400840 treatment lowered body weight by about 16% (41 g vs. 49 g in saline group; P<0.05).

TABLE 13

Effect of antisense oligonucleotides on total body weight (g)

| Week | saline | ISIS 400840 |
|---|---|---|
| 0 | 51 | 51 |
| 1 | 51 | 51 |
| 2 | 51 | 51 |
| 3 | 51 | 49 |
| 4 | 49 | 46 |
| 5 | 50 | 45 |
| 6 | 49 | 42 |
| 7 | 49 | 41 |

Effect on Body Fat Content

Mice were treated by subcutaneous injections twice a week with saline or 25 mg/kg ISIS 400840 and body fat content was measured at weeks 0, 5 and 7.

As shown in Table 14, the mice treated with ISIS 400840 had a significant decrease in body fat content of about 43% (starting at 21 g at week 0 and ending at 12 g at week 7). Saline treated animals showed no decrease in body fat content starting at 21 g at week 0 and ending at 21 g at week 7. The percent body fat content, as calculated by body fat divided by body weight is given in Table 15.

ISIS 400840 did not have an effect on lean body mass (Table 16). ISIS 400840 treatment decreased epididymal white adipose tissue (WATepi) by about 30%, perirenal white adipose tissue (WATperi) by about 53%, and brown adipose tissue (BAT) by about 50% (Table 17).

This data shows that ASO inhibition of SMRT is an effective means for reducing body fat in a diet-induced obesity model. Reductions of body weight and body fat indicate that SMRT inhibitors are useful for the treatment of obesity.

TABLE 14

Effect of antisense oligonucleotides on total body fat content (g)

| Week | Saline | ISIS 400840 |
|---|---|---|
| 0 | 21 | 21 |
| 5 | 21 | 16 |
| 7 | 21 | 12 |

TABLE 15

Effect of antisense oligonucleotides on percentage body fat content (%)

| Week | saline | ISIS 400840 |
|---|---|---|
| 0 | 42 | 40 |
| 5 | 42 | 34 |
| 7 | 42 | 29 |

TABLE 16

Effect of antisense oligonucleotides on lean mass (g)

| Week | saline | ISIS 400840 |
|---|---|---|
| 0 | 26 | 26 |
| 5 | 26 | 26 |
| 7 | 26 | 25 |

TABLE 17

Effect of antisense oligonucleotides on fat depot weight (g)

|  | saline | ISIS 400840 |
|---|---|---|
| WATepi | 2.3 | 1.6 |
| WATperi | 1.5 | 0.7 |
| BAT | 0.4 | 0.2 |

Effect on White Adipose Tissue

Mice were treated by subcutaneous injections twice a week with saline or 25 mg/kg ISIS 400840 and the rate of [$^3$H] fatty acid synthesis in the white adipose tissue was measured. Saline treated mice served as a control. Fatty acid synthesis in the white adipose tissue in ISIS 400840 treated mice was 7 (DPMx $10^3$/hr/g), whereas fatty acid synthesis in the white adipose tissue in saline treated mice was 28 (DPMx $10^3$/hr/g). ISIS 400840 treated mice exhibited approximately a 74% decrease in the level of de novo fatty acid synthesis.

Effect on Plasma Glucose and Insulin Levels

Plasma glucose was determined using an automated clinical chemistry analyzer (Hitachi Olympus AU400e, Melville, MY). Plasma insulin levels were determined using the LIN- COplex system. Changes in fasting plasma glucose and insulin were measured at weeks 0, 3, 5 and 7 (Tables 18 and 19).

ISIS 400840 treatment in the DIO model decreased fasting plasma glucose concentrations by about 19% at week 7 (Table 18). Insulin levels were decreased by about 44% at week 5 with ISIS 400840 treatment (Table 19). Overall, this data signifies an improvement in insulin sensitivity in ISIS 400840 treated mice.

These data show that ASO inhibition of SMRT is an effective means for reducing plasma glucose and increasing insulin sensitivity in a diet-induced obesity model. While not being bound by any one theory, it is hypothesized that plasma glucose is reduced by the downregulation of certain gluconeogenic genes such as Pepck or G6P, and possibly additional less well characterized mechanisms.

TABLE 18

Effect of antisense oligonucleotides on plasma glucose levels (mg/dL)

| Week | saline | ISIS 400840 |
|---|---|---|
| 0 fed | 217 | 214 |
| 3 fed | 257 | 226 |
| 5 Fed | 264 | 239 |
| 7 fed | 212 | 171 |

TABLE 19

Effect of antisense nucleotides on plasma insulin levels (ng/ml)

| Week | saline | ISIS 400840 |
|---|---|---|
| 0 fed | 8.4 | 8.6 |
| 3 fed | 8.7 | 4.4 |
| 5 fed | 8.8 | 4.9 |

Effect on Liver Sterol Synthesis and Secretion

The rate of synthesis of sterols in the liver was measured by providing the mice with tritiated water ($^3H_2O$) for one hour. Liver sterol synthesis decreased by 14% in the ISIS 400840 treated mice, and secretion decreased by 53%, as shown in Table 20.

These data suggest that newly synthesized sterols are inhibited by SMRT inhibition, which results in reduced secretion to the circulatory system.

TABLE 20

Effect of antisense oligonucleotides on liver sterol metabolic levels (DPM × $10^3$/ml/hr)

| | saline | ISIS 400840 |
|---|---|---|
| synthesis | 46 | 39 |
| secretion | 18 | 8 |

Effect on Liver Gene mRNA Levels

The mRNA expressions of the lipogenic enzymes in the liver were measured by qRT-PCR after 7 weeks in the DIO model. The results are shown in Table 21.

In comparison to the saline treated mice, the ISIS 400840 mice exhibited a 84% decrease in FAS expression, a 90% decrease in SCD1 expression, a 45% decrease in DGAT1 expression, a 55% decrease in DGAT2 expression, a 52% decrease in HMG CoA R expression, and a 73% decrease in SREBP1c expression.

The decreases in expression of liver lipogenic genes show that SMRT ASO inhibition modulates lipogenesis. This finding is confirmatory of the decreases in triglycerides and cholesterol demonstrated after SMRT ASO inhibition.

TABLE 21

Percent mRNA expression of liver lipogenic genes in ASO treated mice relative to saline treated mice

| Genes | ISIS 400840 |
|---|---|
| FAS | 16 |
| SCD1 | 10 |
| DGAT1 | 55 |
| DGAT2 | 45 |
| HMG CoA R | 48 |
| SREBP1c | 27 |

Effect on White Adipose Tissue Lipid Metabolism Gene mRNA Expression

The lipid metabolism enzymes described above were also measured in white adipose tissue of the mice and are shown in Table 22.

In comparison to the saline treated mice, the ISIS 400840 mice exhibited a 65% decrease in ACC1 expression, a 9% decrease in ACC2 expression, a 91% decrease in FAS expression, a 55% decrease in SCD1 expression, a 47% decrease in DGAT1 expression, and a 70% decrease in DGAT2 expression.

Peroxisome proliferator activated receptor-γ(PPAR-γ) is an enzyme controlling adipocyte differentiation and adipose tissue function. PPAR-γ expression was decreased 27% in ISIS 400840 treated mice in comparison to saline treated mice.

The decreases in expression of liver lipogenic genes show that SMRT ASO inhibition modulates lipogenesis. This finding is confirmatory of the decreases in triglycerides and cholesterol demonstrated after SMRT ASO inhibition. The decrease in lipogenic and PPAR-γ genes in adipose tissue indicate that SMRT ASO can reduce lipid synthesis, adipose differentiation, and, consequently, decrease adiposity in obese subjects.

TABLE 22

Percent mRNA expression of WAT lipid metabolism genes in ASO treated mice relative to saline treated mice

| Gene | ISIS 400840 |
|---|---|
| ACC1 | 35 |
| ACC2 | 90 |
| FAS | 10 |
| SCD1 | 45 |
| DGAT1 | 53 |
| DGAT2 | 30 |
| PPARg | 73 |

Effect on Glycerol 3-phosphate Acyltransferase (GPAT) mRNA Expression

The enzyme GPAT catalyzes acylation of the glycerol-3-phosphate and, as such, is the first step in the pathway of triacylglycerol synthesis. GPAT mRNA expression was measured in saline treated and ISIS 400840 treated mice, as shown in Table 23. In the ISIS 400840 treated mice GPAT mRNA was decreased by 60% in the liver and 59% in the white adipose tissue (WAT) in comparison to saline treated mice. These data suggest that ASO inhibition of SMRT is an effective means for reducing triglycerides.

TABLE 23

Percent mRNA expression of GPAT in ASO treated mice relative to saline treated mice

| | |
|---|---|
| liver | 40 |
| WAT | 41 |

Example 7

Effect of Long-term Antisense Inhibition of SMRT in the Diet-Induced Model of Obesity (DLO)

Treatment

Male C57BL/6 mice at 6 weeks of age were placed on a high-fat diet containing 58% calories from fat (Research Diet D12330, Research Diets Inc., New Brunswick, N.J.) for 10 weeks. The mice were then divided into four treatment groups. One group received subcutaneous injections of ISIS 400840 at a dose of 25 mg/kg twice per week for 9 weeks. The second group received subcutaneous injections of ISIS 400820 (TTAGACTTTGGTTCCAAATG) at a dose of 25 mg/kg twice per week for 9 weeks. The third group received subcutaneous injections of control oligonucleotide ISIS 141923 (CCTTCCCTGAAGGTTCCTCC) at a dose of 25 mg/kg twice per week for 9 weeks. The fourth control group received subcutaneous injections of saline twice weekly for 9 weeks.

Inhibition of SMRT mRNA

At the end of the nine week treatment period, the mice were sacrificed and SMRT mRNA expression was measured in liver and white adipose tissue (WAT) by real-time PCR.

The results shown in Table 24 are expressed as percent expression relative to saline-treated mice. The data show that both ISIS 400840 and ISIS 400820 effectively inhibit SMRT mRNA expression compared to the control oligonucleotide.

TABLE 24

Percent mRNA expression in ASO treated mice relative to saline treated mice

| | ISIS 141923 | ISIS 400820 | ISIS 400840 |
|---|---|---|---|
| liver | 0 | 36 | 58 |
| WAT | 17 | 56 | 68 |

Effect on Serum Cholesterol and Plasma Lipid Levels

Blood was obtained and analyzed for serum cholesterol and plasma lipids. Measurements were taken at baseline, 5 weeks and 9 weeks.

The data indicates that administration of either ISIS 400840 or ISIS 400820, relative to the saline treated control, effectively reduces triglyceride and cholesterol levels (Tables 25, 26, 27 and 28). Nine weeks after ISIS 400820 treatment, triglycerides levels were reduced by about 21% (from 122 mg/dL to 96 mg/dL) and cholesterol levels were reduced by about 47% (from 288 mg/dL to 154 mg/dL). Nine weeks after ISIS 400840 treatment, triglycerides levels were reduced by about 42% (from 122 mg/dL to 71 mg/dL) and cholesterol levels were reduced by about 49% (from 288 mg/dL to 146 mg/dL). These data show that ASO inhibition of SMRT is an effective means of decreasing plasma triglycerides and cholesterol in a diet-induced obesity model. This data also confirms the data from the short study on the DIO model. Therefore, inhibitors of SMRT are useful for the treatment of hyperlipidemia associated with dysregulated metabolic states such as obesity.

TABLE 25

Effect of antisense oligonucleotides on plasma triglyceride levels (mg/dL)

| Week | saline | ISIS 141923 | ISIS 400820 | ISIS 400840 |
|---|---|---|---|---|
| 0 fed | 177 | 173 | 160 | 166 |
| 5 Overnight fasted | 101 | 122 | 82 | 71 |
| 9 fed | 122 | 105 | 96 | 71 |

TABLE 26

Effect of antisense oligonucleotides on plasma cholesterol levels (mg/dL)

| Week | saline | ISIS 141923 | ISIS 400820 | ISIS 400840 |
|---|---|---|---|---|
| 0 fed | 239 | 229 | 237 | 247 |
| 5 overnight fasted | 269 | 250 | 201 | 153 |
| 9 fed | 288 | 256 | 154 | 146 |

TABLE 27

Effect of antisense oligonucleotides on plasma LDL cholesterol levels (mg/dL)

| Week | saline | ISIS 141923 | ISIS 400820 | ISIS 400840 |
|---|---|---|---|---|
| 0 fed | 32 | 30 | 27 | 29 |
| 5 overnight fasted | 34 | 29 | 26 | 16 |
| 9 fed | 42 | 34 | 19 | 21 |

TABLE 28

Effect of antisense oligonucleotides on plasma HDL cholesterol levels (mg/dL)

| Week | saline | ISIS 141923 | ISIS 400820 | ISIS 400840 |
|---|---|---|---|---|
| 0 fed | 174 | 169 | 155 | 163 |
| 5 Overnight fasted | 176 | 164 | 129 | 97 |
| 9 fed | 199 | 180 | 109 | 100 |

Effect on Plasma Glucose Levels

Plasma glucose was determined using an automated clinical chemistry analyzer (Hitachi Olympus AU400e, Melville, MY). Changes in fasting plasma glucose were measured at baseline, 5 weeks and 9 weeks (Table 29).

ISIS 400820 treatment and ISIS 400840 treatment in the DIO model decreased fasting plasma glucose concentrations by about 9% and 11% respectively at week 9.

These data show that ASO inhibition of SMRT is an effective means for reducing plasma glucose and improving insulin sensitivity in a diet-induced obesity model.

TABLE 29

Effect of antisense oligonucleotides on plasma glucose levels (mg/dL)

| Week | saline | ISIS 141923 | ISIS 400820 | ISIS 400840 |
|---|---|---|---|---|
| 0 fed | 244 | 223 | 234 | 221 |
| 5 overnight fasted | 227 | 228 | 185 | 171 |
| 9 fed | 216 | 215 | 196 | 193 |

Effect on Plasma Insulin Levels

Plasma insulin levels were determined using the LINCO-plex system. Changes in fasting plasma insulin were measured at week 9 (Table 30).

ISIS 400820 treatment and ISIS 400840 treatment in the DIO model reduced insulin levels and improved insulin sensitivity by about 70% and 61% respectively at week 9.

These data show that ASO inhibition of SMRT is an effective means of increasing insulin sensitivity in a diet-induced obesity model. In this model, hyperinsulemia is a reflection of the underlying insulin resistance seen in this model, since animals tend to secrete more insulin to overcome resistance to insulin effects.

TABLE 30

Effect of antisense nucleotides on plasma insulin levels (ng/ml)

| saline | ISIS 141923 | ISIS 400820 | ISIS 400840 |
|---|---|---|---|
| 3.13 | 2.11 | 0.93 | 1.23 |

Effect on Plasma 3HB Concentration

3-HB levels were assayed in the mice groups and are shown in Table 31. 3-HB levels were increased approximately 20% and 50% respectively in mice treated with ISIS 400820 or ISIS 400840 at week 9. Since increased ketone bodies such as 3-HB result from fat oxidation and utilization, the increase in 3-HB suggests an increase in fat oxidation and overall fat metabolism in this model.

TABLE 31

Effect of antisense oligonucleotides on 3-HB (mg/dL)

| Week | saline | ISIS 141923 | ISIS 400820 | ISIS 400840 |
|---|---|---|---|---|
| 0 fed | 82 | 81 | 75 | 104 |
| 5 overnight fasted | 58 | 49 | 120 | 223 |
| 9 fed | 78 | 83 | 98 | 157 |

Effect on Plasma Leptin

Previous studies have shown that fasting serum leptin and insulin concentrations are highly correlated, and insulin sensitive subjects have lower leptin levels than insulin resistant subjects matched for fat mass. Here leptin levels in the plasma were measured at week 9 in mice treated with ISIS 400820 or ISIS 400840 and compared with saline treated mice (Table 32). Leptin levels were decreased by 88% and 75% in mice treated with ISIS 400820 and ISIS 400840 respectively at week 9. This data indicates that treatment with SMRT antisense oligonucleotides may be a effective therapeutic treatment for metabolic disorders such as, but not limited to, insulin resistance.

TABLE 32

Effect of antisense oligonucleotides leptin levels (ng/ml) at week 9

| | saline | ISIS 141923 | ISIS 400820 | ISIS 400840 |
|---|---|---|---|---|
| Leptin | 32 | 18 | 4 | 8 |

Effect on Glucose-6-phosphatase mRNA Expression Levels

Glucose-6-phosphatase (G6P) catalyzes the final step in gluconeogenesis and glycogenolysis, and therefore plays a key role in the homeostatic regulation of blood glucose levels (Nordlie R et al. (1985). *The Enzymes of biological membranes*, 2nd edition. New York: Plenum Press. pp. 349-398).

The mRNA expression levels of G6P were measured in mice treated with either ISIS 400820 or ISIS 400840 at week 9 and compared with the control. Table 33 shows the inhibition in expression of G6P in both treatment groups as percent inhibition over the saline control. This data indicates that SMRT antisense inhibition reduces the pathways of gluconeogenesis and glycogenolysis and therefore, reduces subsequent glucose levels in this model.

TABLE 33

Percent inhibition of G6P mRNA expression compared to the saline control at week 9

| Saline | ISIS 141923 | ISIS 400820 | ISIS 400840 |
|---|---|---|---|
| 0 | 41 | 73 | 73 |

Effect on Insulin Sensitivity

For the insulin tolerance test (ITT), SMRT ASO treated mice were fasted for 5 hours followed by injection with insulin at 0.4 U/kg body weight. Plasma blood glucose levels were monitored for a period of 2 hours. Table 34 presents the modulation of blood glucose levels in the control and treated mice and demonstrates that antisense oligonucleotide reduction of SMRT results in greater reduction of plasma glucose levels in response to insulin levels.

The data illustrate that the improvement in insulin sensitivity is due to treatment with the SMRT antisense oligonucleotides.

TABLE 34

Effect of SMRT antisense oligonucleotides on blood glucose levels (mg/dL) during ITT

| | 0 min | 30 min | 60 min | 90 min | 120 min |
|---|---|---|---|---|---|
| Saline | 173 | 117 | 125 | 134 | 142 |
| ISIS 141923 | 135 | 98 | 91 | 108 | 133 |
| ISIS 400820 | 130 | 78 | 72 | 71 | 92 |
| ISIS 400840 | 109 | 71 | 61 | 72 | 90 |

Effect on Glucose Tolerance

An intraperitoneal glucose tolerance test (IPGTT) was performed on SMRT ASO treated mice which were fasted overnight and administered intraperitoneal injection of glucose at 1.0 g/kg body weight. Blood glucose levels were measured before the glucose challenge (0 minutes) and at different time intervals over 2 hours. The results presented in Table 35 illustrate that plasma glucose levels monitored before and after treatment with SMRT antisense oligonucleotides are lower than that in the saline treated controls. This data indicates that treatment with a SMRT antisense oligonucleotide results in improved glucose tolerance.

TABLE 35

Effect of antisense oligonucleotides on glucose levels (mg/dL) during IPGTT

| | 0 min | 30 min | 60 min | 90 min | 120 min |
|---|---|---|---|---|---|
| Saline | 122 | 248 | 201 | 169 | 154 |
| ISIS 400820 | 89 | 185 | 148 | 130 | 123 |
| ISIS 400840 | 81 | 224 | 150 | 114 | 113 |

Example 8

Effect Antisense Inhibition of SMRT in the Ob/Ob Mouse Model of Obesity

Treatment

Leptin is a hormone produced by fat that regulates appetite. Deficiency of this hormone in both humans and in non-human animals, leads to obesity. ob/ob mice have a mutation in the leptin gene which results in obesity and hyperglycemia. As such, these mice are a useful model for the investigation of obesity and diabetes and related conditions provided herein. These mice models are also useful for testing compounds, compositions and methods designed to treat, prevent or ameliorate such conditions.

In accordance with the present invention, the effects of antisense inhibition of SMRT were investigated in the ob/ob mouse model of obesity. Male ob/ob (C57B1/6J-Lep$^{ob}$/Lep$^{ob}$) mice at 5 weeks of age were purchased from Jackson Laboratories (Bar Harbor, Me.). During a 1 week acclimation period and throughout the study, mice were fed a diet with a fat content of 10-15% (Labdiets #5015, Purina, St. Louis, Mo.).

The mice were divided into three treatment groups. One group received subcutaneous injections of ISIS 400820 at a dose of 25 mg/kg twice per week for 4 weeks. The second group received subcutaneous injections of ISIS 400840 at a dose of 25 mg/kg twice per week for 4 weeks. The third control group received subcutaneous injections of saline twice weekly for 4 weeks.

Inhibition of SMRT mRNA

At the end of the four week treatment period, the mice were sacrificed and SMRT mRNA expression was measured in liver and white adipose tissue (WAT) by real-time PCR.

The results shown in Table 36 are expressed as percent expression relative to saline-treated mice. The data show that both ISIS 400840 and ISIS 400820 effectively inhibit SMRT mRNA expression compared to the control oligonucleotide.

TABLE 36

Percent Reduction of mRNA expression in ASO treated mice relative to saline treated mice

| | Saline | ISIS 400820 | ISIS 400840 |
|---|---|---|---|
| liver | 0 | 77 | 79 |
| WAT | 0 | 48 | 49 |

Effect on Serum Cholesterol and Plasma Lipid Levels

Blood was obtained and analyzed for plasma cholesterol and plasma lipids levels. Measurements were taken at baseline (0 weeks), 2 weeks and 4 weeks.

The data indicates that administration of either ISIS 400840 or ISIS 400820, relative to the saline treated control, effectively reduced triglyceride levels, though cholesterol levels remained the same (Tables 37, 38, 39 and 40). At 4 weeks after ISIS 400820 treatment, triglycerides levels are reduced by about 45% (from 271 mg/dL to 148 mg/dL). At 4 weeks after ISIS 400840 treatment, triglycerides levels were reduced by about 65% (from 271 mg/dL to 96 mg/dL). These data show that ASO inhibition of SMRT is an effective means for decreasing plasma triglycerides in a genetically-induced obesity model. Therefore, inhibitors of SMRT may be useful for the treatment of hyperlipidemia associated with dysregulated metabolic states such as obesity.

TABLE 37

Effect of antisense oligonucleotides on plasma triglyceride levels (mg/dL)

| Week | saline | ISIS 141923 | ISIS 400820 | ISIS 400840 |
|---|---|---|---|---|
| 0 | 301 | 278 | 230 | 228 |
| 2 | 413 | 305 | 252 | 146 |
| 4 | 271 | 257 | 148 | 96 |

TABLE 38

Effect of antisense oligonucleotides on plasma cholesterol levels (mg/dL)

| Week | saline | ISIS 141923 | ISIS 400820 | ISIS 400840 |
|---|---|---|---|---|
| 0 | 254 | 234 | 211 | 252 |
| 2 | 199 | 197 | 210 | 195 |
| 4 | 195 | 206 | 211 | 212 |

TABLE 39

Effect of antisense oligonucleotides on plasma LDL cholesterol levels (mg/dL)

| Week | saline | ISIS 141923 | ISIS 400820 | ISIS 400840 |
|---|---|---|---|---|
| 0 | 31 | 29 | 27 | 31 |
| 2 | 30 | 34 | 26 | 22 |
| 4 | 28 | 33 | 23 | 24 |

TABLE 40

Effect of antisense oligonucleotides on plasma HDL cholesterol levels (mg/dL)

| Week | saline | ISIS 141923 | ISIS 400820 | ISIS 400840 |
|---|---|---|---|---|
| 0 | 152 | 140 | 126 | 149 |
| 2 | 146 | 143 | 163 | 154 |
| 4 | 148 | 154 | 168 | 166 |

Effect on Plasma Glucose Levels

Plasma glucose was determined using an automated clinical chemistry analyzer (Hitachi Olympus AU400e, Melville, MY). Changes in fasting plasma glucose were measured at baseline, 2 weeks and 4 weeks (Table 41).

Treatment with ISIS 400820 and ISIS 400840 in the ob/ob model decreased fasting plasma glucose concentrations by about 45% and 55% respectively at week 4.

These data show that ASO inhibition of SMRT is an effective means for reducing plasma glucose in a genetically-induced obesity model. While not being bound by any one theory, it is hypothesized that plasma glucose is reduced by the downregulation of certain gluconeogenic genes such as Pepck or G6P, and possibly additional less well characterized mechanisms.

TABLE 41

Effect of antisense oligonucleotides on plasma glucose levels (mg/dL)

| Week | saline | ISIS 400820 | ISIS 400840 |
|---|---|---|---|
| 0 | 460 | 462 | 463 |
| 2 | 620 | 499 | 390 |
| 4 | 640 | 353 | 288 |

Effect on Gluconeogenic Gene Levels

Both PEPCK and glucose-6-phosphatase are key enzymes in gluconeogenesis. It can be hypothesized; therefore, that down-regulation in these enzymes at the gene level would inhibit gluconeogenesis and reduce plasma glucose as a result.

Treatment with ISIS 400840 caused decrease in the levels of Pepck and G6P, as presented in Table 42. Gluconeogenesis is a major factor contributing to hyperglycemia in subjects with Type 2 diabetes. These results further indicate that inhibition of SMRT expression could have therapeutic benefit in subjects having metabolic disorders, such as Type 2 diabetes.

TABLE 42

Percent mRNA expression in ASO treated mice relative to saline treated mice

|  | Saline | ISIS 400820 | ISIS 400840 |
|---|---|---|---|
| Pepck | 0 | 18 | 40 |
| G6P | 0 | 9 | 55 |

Effect on Insulin Sensitivity

For the insulin sensitivity tolerance test (ITT), mice treated as described were fasted for 5 hours, injected with insulin at 0.7 U/kg and tested for blood glucose levels over a period of 90 min. Table 43 presents the modulation of blood glucose levels in the control and treated mice and demonstrates that antisense inhibition of SMRT resulted in decreased glucose levels both at the initiation of and during the ITT.

The data illustrate that improvement in insulin sensitivity occurred due to treatment with the SMRT antisense oligonucleotides.

TABLE 43

Effect of SMRT antisense oligonucleotides on glucose levels (mg/dL) during ITT

|  | 0 min | 30 min | 90 min |
|---|---|---|---|
| Saline | 429 | 476 | 344 |
| ISIS 400820 | 275 | 169 | 102 |
| ISIS 400840 | 184 | 165 | 103 |

Example 9

Antisense Inhibition of SMRT in a T3-hypothyroid Mouse Model

A mouse model for thyroid hormone (TH) deficiency was developed that could be used for screening and evaluating coregulator SMRT using antisense oligonucleotide ISIS 400840 and to identify targets and target genes that could augment or mimic thyroid hormone action in the liver.

Mice were rendered TH deficient (hypothyroid mice) by placing them on a low iodine diet containing 0.15% 5-propyl-2-thiouracil (LI-PTU) (Harlan teklad Co., Madison, Wis.) for more than 5 weeks. Hypothyroid status was confirmed by reductions in serum T4 and T3 levels in parallel with an upregulation in the levels of serum TSH, and suppression of known TH-responsive genes. Stimulation of the TH-receptor pathway in hypothyroid animals was demonstrated by T3 treatment.

Inhibition of SMRT mRNA

TH deficient mice were divided into four treatment groups. One group received subcutaneous injections of ISIS 400840 at a dose of 37.5 mg/kg twice per week for 4 weeks. The second group received subcutaneous injections of ISIS 400840 at a dose of 37.5 mg/kg twice per week plus T3 (300 µg/Kg BW) injections 4 hours before sacrifice. The third group was given T3 injections alone. The fourth group received subcutaneous injections of saline twice weekly for 4 weeks. The saline-injected group served as the control group to which the other groups were compared. All groups were given LI-PTU diet during the treatment period.

In another set of experiments, similar ASO treatment was given but the mice were given normal chow during the treatment period.

At the end of the four week treatment period, the mice were sacrificed and SMRT mRNA expression was measured in liver. Levels of mRNA expression were determined by real-time PCR and shown in Table 44. The data are expressed as percent inhibition relative to saline treated animals.

Hypothyroid mice treated with ISIS 400840 exhibited a 68% reduction of SMRT mRNA expression in the liver and 81% in the white adipose tissue (WAT). Hypothyroid mice on saline when treated with T3 exhibited approximately a three-fold increase in SMRT mRNA expression in the liver whereas a reduction of 56% was observed in the WAT. Furthermore, hypothyroid mice that were treated with ISIS 400840 plus T3 exhibited a 28% decrease of SMRT mRNA expression in the liver and 81% of SMRT mRNA expression in the WAT relative to the saline plus T3 treatment group.

These data suggest that ASO inhibition of SMRT may mimic T3 stimulation and, as such, is a useful therapeutic for ameliorating symptoms of hypothyroidism, such as obesity.

Saline treated mice on a normal diet exhibited 17% increase in SMRT mRNA expression in the liver and 70% decrease in the WAT in comparison to saline treated mice on a low iodine diet. Mice treated with ISIS 400840 on a normal diet exhibited a 64% decrease in mRNA expression in the liver in comparison to the saline treated mice on a low iodine diet. mRNA expression was decreased by 85% in the WAT.

TABLE 44

Percent mRNA change relative to saline treated mice

| Injection | Diet | Liver | WAT |
|---|---|---|---|
| Saline | Low iodine | 0 | 0 |
| ISIS 400840 | Low iodine | +68 | +81 |
| saline + T3 | Low iodine | −199 | +56 |
| ISIS 400840 + T3 | Low iodine | +28 | +81 |
| Saline | Normal | −17 | +70 |
| ISIS 400840 | Normal | +64 | +85 |

Effect on Plasma Cholesterol and Triglycerides

Plasma cholesterol and triglycerides were measured after 4 weeks (Table 45) of SMRT ASO treatment. Cholesterol and triglycerides were decreased in all groups as compared to the saline treated mice on a low iodine diet. Mice on a low iodine diet and treated with ISIS 400840 only exhibited approximately a 49% decrease in plasma cholesterol and approximately a 55% decrease in plasma triglycerides. Mice on a low iodine diet and treated with ISIS 400840 plus T3 exhibited approximately a 57% decrease in plasma cholesterol and a 67% decrease in plasma triglycerides.

These data are consistent with those obtained in other hyperglycemic models and suggest that treatment with ASOs targeting SMRT may correct the hyperlipidemia that often accompanies congenital or acquired thyroid deficiency. Thus, SMRT ASO treatment may be used in conjunction with thyroxine supplementation in patients with hypothyroid states, especially those with high cardiovascular risk.

TABLE 45

Effect of antisense oligonucleotides and diet on plasma cholesterol and triglycerides (mg/dL)

| Injection | Diet | CHOL | TRIGS |
|---|---|---|---|
| Saline | Low iodine | 213 | 113 |
| ISIS 400840 | Low iodine | 108 | 51 |
| saline + T3 | Low iodine | 187 | 100 |
| ISIS 400840 + T3 | Low iodine | 88 | 37 |
| Saline | Normal | 73 | 103 |
| ISIS 400840 | Normal | 51 | 50 |

Effect on Plasma Glucose and T4 Levels

Plasma glucose and T4 concentration was measured after 4 weeks of SMRT ASO treatment. Glucose was decreased in all groups compared to the saline treated mice on a low iodine diet. Mice treated with ISIS 400840 only on a low iodine diet exhibited a decrease in glucose of approximately 11%. Mice treated with ISIS 400840 plus T3 on a low iodine diet exhibited a decrease in glucose of approximately 57%.

These data, as presented in Table 46, indicate that SMRT ASO can result in amelioration of insulin resistance and hyperglycemia in patients with thyroid. This tissue specific thyro-mimic action can also improve hyperglycemia in hypothyroid subjects who may also have type 2 diabetes mellitus.

TABLE 46

Effect of antisense oligonucleotides and LI-PTU diet on plasma glucose and T4 concentration (mg/dL)

| Injection | Diet | GLU | T4 |
|---|---|---|---|
| saline | Low iodine | 264 | 0 |
| ISIS 400840 | Low iodine | 234 | 0 |
| saline + T3 | Low iodine | 212 | 0.5 |
| ISIS 400840 + T3 | Low iodine | 114 | 0 |
| Saline | Normal | 256 | 3.7 |
| ISIS 400840 | Normal | 253 | 4.6 |

Effect on Plasma NEFA and 3HB Concentration

NEFA and 3-HB levels were assayed in the mice groups and are shown in Table 47. NEFA levels decreased in mice on a low iodine diet and treated with ISIS 400840 by about 50% compared to the saline treated mice. Mice on a low iodine diet treated with ISIS 400840 plus T3 showed a decrease of about 33%. 3-HB levels were not affected by ISIS 400840 in mice on a low iodine diet but were decreased when T3 injections were given (approximately 48% decrease in ISIS 400840 group vs. saline group). In mice on a normal diet, 3-HB levels were increased approximately 32%. Since increased ketone bodies such as 3-HB result from fat oxidation and utilization, the increase in 3-HB suggests an increase in fat oxidation.

TABLE 47

Effect of antisense oligonucleotides and diet on NEFA (mEq/L) and 3-HB (mg/dL)

| Injection | Diet | NEFA | 3HB |
|---|---|---|---|
| saline | Low iodine | 0.6 | 112 |
| ISIS 400840 | Low iodine | 0.3 | 111 |
| saline + T3 | Low iodine | 0.6 | 80 |
| ISIS 400840 + T3 | Low iodine | 0.4 | 41 |
| Saline | Normal | 0.8 | 110 |
| ISIS 400840 | Normal | 0.5 | 161 |

Further confirming, as provided herein, the present invention provides SMRT-specific modulators that modulate or inhibit SMRT expression, activity, or processing. Such agents are candidate therapeutic agents for the treatment of both metabolic and cardiovascular disorders, such as Type 2 diabetes, obesity and hypercholesterolemia, or any combination thereof.

The in vivo studies provided herein are carried out in well characterized models of disease that are recognized by those of skill in the art as being predictive of therapeutic results in other animals, including humans Example 10

Antisense Inhibition of Rat SMRT: Rat Primary Hepatocytes

Antisense oligonucleotides targeted to a SMRT nucleic acid were tested for their effects on SMRT mRNA in vitro. Cultured rat primary hepatocytes were transfected using lipofectin reagent with 100 nM antisense oligonucleotide for 4 hours. After a recovery period of approximately 24 hours, RNA was isolated from the cells and SMRT mRNA levels were measured by quantitative real-time PCR. SMRT mRNA levels were adjusted according to total RNA content, as measured by RIBOGREEN®. Results are presented as percent inhibition of SMRT, relative to untreated control cells.

The chimeric antisense oligonucleotides in Table 48 were designed as 5-10-5 MOE gapmers. The gapmers are 20 nucleotides in length, wherein the central gap segment is comprised of 10 2'-deoxynucleotides and is flanked on both sides (in the 5' and 3' directions) by wings comprising 5 nucleotides each. Each nucleotide in the 5' wing segment and each nucleotide in the 3' wing segment has a 2'-MOE modification. The internucleoside linkages throughout each gapmer are phosphorothioate (P=S) linkages. All cytidine residues throughout each gapmer are 5-methylcytidines. "Rat target start site" indicates the 5'-most nucleotide to which the gapmer is targeted in the rat sequence. "Rat target stop site" indicates the 3'-most nucleotide to which the gapmer is targeted in the rat sequence. Each gapmer listed in Table 48 is targeted to rat target sequence (GenBank accession number 3377_025_E, incorporated herein as SEQ ID NO: 124; or GenBank accession number NW_047375.1 truncated from nucleotides 3996000 to 4161000, incorporated herein as SEQ ID NO: 125; or GenBank accession number 3377_025_D, incorporated herein as SEQ ID NO: 126.

The rat oligonucleotides also show cross reactivity with the human SMRT mRNA (GENBANK Accession No.

NM_006312.1), incorporated herein as SEQ ID NO: 2. "Human Target Start Site" indicates the 5'-most nucleotide in the human mRNA to which the antisense oligonucleotide is targeted. "Human Target Stop Site" indicates the 3'-most nucleotide in the human mRNA to which the antisense oligonucleotide is targeted. 'Mismatches' indicates the number of nucleobases by which the rat oligonucleotide is mismatched with the human gene sequence. n/a indicates that there was no cross-reactivity between the rat oligonucleotide and the human gene sequence.

TABLE 48

Inhibition of rat SMRT mRNA levels by chimeric antisense oligonucleotides having 5-10-5 MOE wings and deoxy gap

| ISIS No. | Rat Target Start Site | Rat Target Stop Site | Sequence (5' to 3') | % inhibition | Human Target Start Site | Human Target Stop Site | Mismatches | Rat Target Sequence | SEQ ID NO |
|---|---|---|---|---|---|---|---|---|---|
| 400776 | 1736 | 1755 | GTCAGGTAGTAATAGAGGAC | 76 | 1400 | 1419 | 0 | 3377_025_E | 53 |
| 400785 | 3218 | 3237 | TTCAGCTGCTTCAGGTCCAG | 72 | 2882 | 2901 | 0 | 3377_025_E | 62 |
| 400801 | 6380 | 6399 | AAGGGTTTACTTTGAGTCTT | 62 | 6074 | 6093 | 0 | 3377_025_E | 78 |
| 400803 | 6393 | 6412 | TTCCTGGATGGAAAAGGGTT | 66 | 6087 | 6106 | 0 | 3377_025_E | 80 |
| 400811 | 7310 | 7329 | AGCCCCATGTTGGTGCTGGC | 67 | 7007 | 7026 | 0 | 3377_025_E | 88 |
| 400814 | 7406 | 7425 | CTGGCATTCAGAGGGTTAAA | 58 | 7103 | 7122 | 0 | 3377_025_E | 91 |
| 400817 | 8027 | 8046 | GTTAAGGCTTTAGACAGGCA | 75 | 7714 | 7733 | 0 | 3377_025_E | 94 |
| 400818 | 8037 | 8056 | GGGAGTCTTAGTTAAGGCTT | 69 | 7724 | 7743 | 0 | 3377_025_E | 95 |
| 400837 | 849 | 868 | GTCCATGTTCTGGATCAGCT | 86 | 513 | 532 | 0 | 3377_025_E | 114 |
| 410818 | 3930 | 3949 | TGCCATGCACACAGTAAGTG | 52 | n/a | n/a | n/a | NW_047375.1_TRUNC_3996000_4161000 | 127 |
| 410819 | 27933 | 27952 | TCAGAAGATGCAGGCAGTAT | 42 | n/a | n/a | n/a | NW_047375.1_TRUNC_3996000_4161000 | 128 |
| 410820 | 74092 | 74111 | CAGGCCATACCCGGTTCTCG | 62 | n/a | n/a | n/a | NW_047375.1_TRUNC_3996000_4161000 | 129 |
| 410821 | 82367 | 82386 | TGTACAGAGGCTGCAGAGGA | 67 | n/a | n/a | n/a | NW_047375.1_TRUNC_3996000_4161000 | 130 |
| 410822 | 101167 | 101186 | GACGACACTGGATCCCCTAG | 80 | n/a | n/a | n/a | NW_047375.1_TRUNC_3996000_4161000 | 131 |
| 410823 | 121443 | 121462 | GCTCTGGGCAGGACAGGACC | 80 | n/a | n/a | n/a | NW_047375.1_TRUNC_3996000_4161000 | 132 |

TABLE 48-continued

Inhibition of rat SMRT mRNA levels by chimeric antisense
oligonucleotides having 5-10-5 MOE wings and deoxy gap

| ISIS No. | Rat Target Start Site | Rat Target Stop Site | Sequence (5' to 3') | % inhibition | Human Target Start Site | Human Target Stop Site | Mis-matches | Rat Target Sequence | SEQ ID NO |
|---|---|---|---|---|---|---|---|---|---|
| 410824 | 121669 | 121688 | CCAGCTGCCCCAGGGAGCTG | 63 | n/a | n/a | n/a | NW_047375.1_TRUNC_3996000_4161000 | 133 |
| 410825 | 128481 | 128500 | CCCCGTGTCTGAGGCCCAGT | 57 | n/a | n/a | n/a | NW_047375.1_TRUNC_3996000_4161000 | 134 |
| 410826 | 5707 | 5726 | GGTGGACCTCAGGACCGTGG | 72 | 5685 | 5704 | 0 | 3377_025_D | 135 |
| 410827 | 6070 | 6089 | TGCCACCAAGTGGGCAGTGG | 65 | 5752 | 5771 | 2 | 3377_025_E | 136 |
| 410828 | 190 | 209 | GTGTTCCTCAAAGACTCAGG | 74 | n/a | n/a | n/a | 3377_025_E | 137 |
| 410829 | 450 | 469 | GTGTTGGTACTCAAGCAGCC | 61 | 114 | 133 | 3 | 3377_025_E | 138 |
| 410830 | 704 | 723 | GGCTGCCCAGTGGCCAGCAG | 73 | 368 | 387 | 2 | 3377_025_E | 139 |
| 410831 | 739 | 758 | GGCTGCGGTCCTTGGTAAGA | 84 | 403 | 422 | 3 | 3377_025_E | 140 |
| 410832 | 1096 | 1115 | GCTGGTTGTACAGAGGCAGC | 70 | 760 | 779 | 1 | 3377_025_E | 141 |
| 410833 | 1150 | 1169 | TCCGCATCGCCTGGTTTATT | 79 | 814 | 833 | 0 | 3377_025_E | 142 |
| 410834 | 1403 | 1422 | GAGAGCCCACTGCCACGCTG | 85 | 1067 | 1086 | 2 | 3377_025_E | 143 |
| 410835 | 1594 | 1613 | GGTCTTTGTACACCTTCATG | 79 | 1258 | 1277 | 0 | 3377_025_E | 144 |
| 410836 | 1669 | 1688 | AGTTCTTGGGATGCTGCATG | 84 | 1333 | 1352 | 0 | 3377_025_E | 145 |
| 410837 | 1682 | 1701 | GCGATCAGGCCAAAGTTCTT | 69 | 1346 | 1365 | 0 | 3377_025_E | 146 |
| 410838 | 2015 | 2034 | TTGCGGCCTTTGGAGGCCAC | 60 | 1691 | 1710 | 0 | 3377_025_E | 147 |
| 410839 | 2025 | 2044 | GTTGGCAGTTTTGCGGCCTT | 74 | 1701 | 1720 | 0 | 3377_025_E | 148 |
| 410840 | 2192 | 2211 | TCCAGGAGGCCTTTCTTTGC | 73 | 1868 | 1887 | 2 | 3377_025_E | 149 |
| 410841 | 2245 | 2264 | ACACAGTCTTGGAGCCCACC | 60 | 1921 | 1940 | 0 | 3377_025_E | 150 |
| 410842 | 2315 | 2334 | TTGTGCTGCTGAAGGATTTC | 34 | 1991 | 2010 | 3 | 3377_025_E | 151 |
| 410843 | 2717 | 2736 | GGTGGGCCACTGGCATCAGG | 80 | n/a | n/a | n/a | 3377_025_E | 152 |
| 410844 | 3727 | 3746 | ACATTCCCTGCTGGGAGATG | 37 | n/a | n/a | n/a | 3377_025_E | 153 |
| 410845 | 3877 | 3896 | GCCCAGCCTGACCCCGAGGG | 76 | 3520 | 3539 | 2 | 3377_025_E | 154 |

TABLE 48-continued

Inhibition of rat SMRT mRNA levels by chimeric antisense
oligonucleotides having 5-10-5 MOE wings and deoxy gap

| ISIS No. | Rat Target Start Site | Rat Target Stop Site | Sequence (5' to 3') | % inhibition | Human Target Start Site | Human Target Stop Site | Mis-matches | Rat Target Sequence | SEQ ID NO |
|---|---|---|---|---|---|---|---|---|---|
| 410846 | 4139 | 4158 | ATGACATGGCCCTTGGGCAG | 71 | 3788 | 3807 | 1 | 3377_025_E | 155 |
| 410847 | 4277 | 4296 | TCCATCATGTCATAGGTGCG | 76 | 3926 | 3945 | 0 | 3377_025_E | 156 |
| 410848 | 4340 | 4359 | GGGATGGCACGGCCCATGAG | 69 | 3989 | 4008 | 0 | 3377_025_E | 157 |
| 410849 | 4391 | 4410 | ATGGAGCCTCGGATGTGATG | 42 | 4046 | 4065 | 3 | 3377_025_E | 158 |
| 410850 | 4614 | 4633 | ATGGATAGAGCGGCCCGCCT | 68 | 4260 | 4279 | 1 | 3377_025_E | 159 |
| 410851 | 4679 | 4698 | TCCTTCAGAGGCCGTGGTGC | 55 | n/a | n/a | n/a | 3377_025_E | 160 |
| 410852 | 4985 | 5004 | AAGGGTGCCCCGTGGTCCTC | 76 | 4631 | 4650 | 0 | 3377_025_E | 161 |
| 410853 | 5093 | 5112 | GTCAGCTTCCGGTCCTGGGA | 83 | 4739 | 4758 | 1 | 3377_025_E | 162 |
| 410854 | 5365 | 5384 | TGTCAGGGTAGCCGCGGATG | 54 | 5008 | 5027 | 1 | 3377_025_E | 163 |
| 410855 | 5405 | 5424 | TAGTCATTGATGATGGTCTG | 67 | 5048 | 5067 | 0 | 3377_025_E | 164 |
| 410856 | 5416 | 5435 | GCGAGGTGATGTAGTCATTG | 71 | 5059 | 5078 | 0 | 3377_025_E | 165 |
| 410857 | 5428 | 5447 | GGTGCATCTGCTGCGAGGTG | 79 | 5071 | 5090 | 0 | 3377_025_E | 166 |
| 410858 | 5484 | 5503 | CGGTGACAGACCCCTCAGCA | 75 | n/a | n/a | n/a | 3377_025_E | 167 |
| 410859 | 5552 | 5571 | GGCACTTGGGACAGGTCGAT | 74 | 5195 | 5214 | 0 | 3377_025_E | 168 |
| 410860 | 5560 | 5579 | GCAGGTGTGGCACTTGGGAC | 71 | 5203 | 5222 | 0 | 3377_025_E | 169 |
| 410861 | 5705 | 5724 | GTTGGTTTAGCTAGGTGAGT | 61 | n/a | n/a | n/a | 3377_025_E | 170 |
| 410862 | 5952 | 5971 | GACCACGCCCTTCATGCTCG | 72 | n/a | n/a | n/a | 3377_025_E | 171 |
| 410863 | 6414 | 6433 | ACCCAGAGAACGGAGTTCCA | 68 | 6108 | 6127 | 0 | 3377_025_E | 172 |
| 410864 | 6420 | 6439 | GTGGTAACCCAGAGAACGGA | 56 | 6114 | 6133 | 0 | 3377_025_E | 173 |
| 410865 | 6618 | 6637 | CAGTGGCCGCAGATGTGGGA | 48 | 6309 | 6328 | 2 | 3377_025_E | 174 |
| 410866 | 6722 | 6741 | GTAATGACCTCACTGATGTG | 67 | 6413 | 6432 | 1 | 3377_025_E | 175 |
| 410867 | 6915 | 6934 | TTCTGGAGACCTTTTGCCCC | 61 | 6606 | 6625 | 2 | 3377_025_E | 176 |
| 410868 | 6996 | 7015 | ATGTCCTGGCTCAGTCATGC | 65 | 6690 | 6709 | 3 | 3377_025_E | 177 |
| 410869 | 7084 | 7103 | GGCTGGTGTTGCCTGGAGAC | 81 | 6781 | 6800 | 0 | 3377_025_E | 178 |

TABLE 48-continued

Inhibition of rat SMRT mRNA levels by chimeric antisense oligonucleotides having 5-10-5 MOE wings and deoxy gap

| ISIS No. | Rat Target Start Site | Rat Target Stop Site | Sequence (5' to 3') | % inhibition | Human Target Start Site | Human Target Stop Site | Mis- matches | Rat Target Sequence | SEQ ID NO |
|---|---|---|---|---|---|---|---|---|---|
| 410870 | 7133 | 7152 | ACCATGGCGGAGTTGCTCTC | 69 | 6830 | 6849 | 0 | 3377_025_E | 179 |
| 410871 | 7202 | 7221 | ATATTGTATTCAGGCTCATT | 57 | 6899 | 6918 | 0 | 3377_025_E | 180 |
| 410872 | 7341 | 7360 | ACCCATGAGTGCCTTTCTAA | 67 | 7038 | 7057 | 0 | 3377_025_E | 181 |
| 410873 | 7395 | 7414 | AGGGTTAAAAGCATTGGCGC | 34 | 7092 | 7111 | 0 | 3377_025_E | 182 |
| 410874 | 7539 | 7558 | TGGCGACTTGGCTTTTCGGC | 80 | 7233 | 7252 | 2 | 3377_025_E | 183 |
| 410875 | 7814 | 7833 | TGTGAACACAGCAGTGGCTT | 70 | 7508 | 7527 | 3 | 337_7025_E | 184 |
| 410876 | 7999 | 8018 | GCTCTGGATGGACAGATGAG | 72 | 7685 | 7704 | 3 | 3377_025_E | 185 |
| 410877 | 8088 | 8107 | CAGGTAAACATCCCCTGAGT | 69 | 7771 | 7790 | 0 | 3377_025_E | 186 |
| 410878 | 8258 | 8277 | TAGACTTTGGTTCCAAATGC | 78 | 7925 | 7944 | 0 | 33770_25_E | 187 |
| 410879 | 8341 | 8360 | GGCAGGATAAGCTGGGAACG | 63 | n/a | n/a | n/a | 3377_025_E | 188 |
| 410880 | 8527 | 8546 | TAAGCCAACACCATTTACAC | 63 | n/a | n/a | n/a | 3377_025_E | 189 |
| 410881 | 8555 | 8574 | TCATTGAAGGTATCAAAAAT | 40 | 8236 | 8255 | 0 | 3377_025_E | 190 |
| 410882 | 8704 | 8723 | GCCGTGTGCCGGAGCCCCTG | 80 | n/a | n/a | n/a | 3377_025_E | 191 |
| 410883 | 8738 | 8757 | ATTCTGCCCAAGGAAGGGAG | 55 | 8428 | 8447 | 0 | 3377_025_E | 192 |
| 410884 | 8764 | 8783 | GCGGCCACAGAATACGCATC | 67 | 8454 | 8473 | 0 | 3377_025_E | 193 |
| 410885 | 8809 | 8828 | AATTGGAACAACATGTGTAA | 68 | 8504 | 8523 | 3 | 3377_025_E | 194 |

Other Embodiments

The detailed description set-forth above is provided to aid those skilled in the art in practicing the present invention. However, the invention described and claimed herein, is not to be limited in scope by the specific embodiments disclosed herein because these embodiments are intended as illustration of several aspects of the invention. Any equivalent embodiments are intended to be within the scope of this invention. Indeed, various modifications of the invention in addition to those shown and described herein will become apparent to those skilled in the art from the foregoing description which does not depart from the spirit or scope of the present inventive discovery. Such modifications are also intended to fall within the scope of the appended claims.

REFERENCES CITED

All publications, patents, patent applications and other references cited in this application are incorporated herein, by reference in their entirety for all purposes to the same extent as if each subject publication, patent, patent application or other reference was specifically and subjectively indicated to be incorporated by reference in its entirety for all purposes. Citation of a reference herein, shall not be construed as an admission that such is prior art to the present invention.

SEQUENCE LISTING (194 sequences)

SEQ ID NO: 1 - DNA, 8686 bp, H. sapiens
gagtctttgaggacacagcctcgctggaggcagtttctggtgccagtgacggggtggcccgtgagctgatgacgaggactggcttttaatccttggtggtgattaagagaaagcttattggggcctgggagcagctccccgccgacccccaccaccatgtcgggctccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggttcgcgagtactacgagaagcagttccctgagatccgcaagcagcgcgagctgcaggagcgcatgcagagggtgggccagcggggcagtgggctgtccatgtcgcccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgacgggaaatgaggaggagatggtggaggaggctgaagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagtccaccccggcctctgaagccaccttagcccctacgcccccaccagcacccccatttccctcttcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagagggcgctcaaggcagagaagaaggagggcgggagcggcagggccaccacagccaagagctcgggcgccccccaggacagcgactccagtgccacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccatgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcaagcccacggtcctgaggtccacctccacctcctcacccgttcgcccagctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcggggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacacaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctcgtcacgccccgctgtgtcctccctccctcccttccttgggcagaatgaattcgatgcgtattctgtggccgccatttgcgcagggtggtggtattctgtcatttacacacgtcgttctaattaaaaagcgaattatactccaaaaaaaaaaaaaaaaaaa

SEQ ID NO: 2 - DNA, 8561 bp, H. sapiens
catgtcgggctccacacagcttgtggcacagacgtggagggccactgagccccgctacccgccccacagcctttcctacccagtgcagatcgcccggacgcacacggacgtcgggctcctggagtaccagcaccactcccgcgactatgcctcccacctgtcgccgggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatggaagcagaagttctgccagcgctatgaccagctcatggaggccttggaaaaaaaggtggagcgcatcgaaaacaacccgcgccggcgggccaaggagagcaaggtgcgcgagtactacgaaaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccaggcccacccaccccaccacggaggacatcccgggcccccattgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccatgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcaagcccacggtcctgaggtccacctccacctcctcacccgttcgcccagctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcggggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacacaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctcgtcacgccccgctgtgtcctccctccctcccttccttgggcagaatgaattcgatgcgtattctgtggccgccatttgcgcagggtggtggtattctgtcatttacacacgtcgttctaattaaaaagcgaattatactccaaaaaaaaaaaaaaaaaaa

SEQ ID NO: 3 - DNA, 221000 bp, H. sapiens
  misc_feature (1)...(221000): n = A,T,C or G
ctgtctgctgttggactgactggctcatattgatttgtgggtgtcccctctgtattctgggtactagctatcattgcactacttttgactttgtatggtaactcagaaattcttaaatgaggctgggcacagtggctcgcacctgtaatcctagcactttgggaggccaaggcaggaggattgcttgagctcaggagtttgaaaccagcctgggcaacatggtgagaccctgtctctacaaaaaaatacaaaaattagccgggcatggtggcacgtgcccatagtcccagctacttagcaggcttaggtgggaggatcgccttagggttggggctgcagggagccatgattgcaccccagcctgagtgacagagcgagactatatccaaaacaaaaacaaaaacaaaaacactccaaaataccaaacaaacaaaaataaattcttgcatgagaatagtagacacccccacccccggaccccatccttcaggtgtccgtcgacccatctccctgtttgtggggtcctctgggtagttaatggggcagtttcccagtagcctagccgtgtggcccggggcccctcggtggtcttgccagggtgtgtgggatgcctttaaacccacacatctgggattgaatcacagctccgtcacttcccggctctgagaacctgggcatgagatttgattgtctgagcgtcagtctccctctctgtcaaataggtagcagtacctgcctcacagggttctcatggagaaatacttggcccagtgcttacgacacatgggccctgacggcagacatggtcttttttcctgcatgtcggtgtcgtcatgccaaactgcatacatgcgatgtcaactaacaaaacccgtgttttgtctgcaggtctccctgagtctttgaggacacagcctcgctggaggcagtttctggtaggttcatgtctgtctccacttggtgtccccaggaggttcatcctgcctggactttctcacgggaagtgggtctggaattactcggagccaggttcggcctggagtgtgtggtgggggcctcggggggcgtgtggggtctggcacatcagagctgtccagggcagggagcaacttagggcagtttgcggggtcccccagtgatgggccgtttcctggctgagttggtgcagtgattttttgatgacacctgagaggtgggagggtccctgacagtgtcagtgtcaggagggtgggcttccccgggctccggggttcttggtcacattgcttttgtgctttggcggtgggcccgcaggtttggccagggtggggcctgtcgatgggcccaggtgttcgggtgttgggtgctggaggaagccctgaggctgaaccaccactgtggtccccgtgcctagcaggcaaagaggtggcctgggtcctggtcttatcactgctacttctgtgctgggcactggggccaggttgctttatctctctgtatctctgtttctccatctgtagactgggcggggaggcaataacagtttccccttatagggttttgctgcggtgattaatgctcatagagagcagtgcctggcctgagaaggtgcctggtgagtcataatcacaggtcgtgcttttcacaggtcaccccattttgtgaccctcacagcaacactccagaatgggtggtgcctcattttacaagtggggaaactgaggcacaggttggtcacctgtcccagatctttcagctggaagcaaagagccagaagcaaagaaccccttctcacccttcccagggaatgcagcaagtttctcctggagtgctcatttcccagccaggcagatggtcgctgagggcattgcagggctcgtgcgcatggaggctggggcacatggcgggcacacagcgtgttctggctcatgacaggctgttgtcgggagatttcattcttgttccaaatacagtcatgtgctgcataacgacattctggtcaacgatggaccgcatatatgacagtggtcccataagattataataccacatttttttttttttcgagacagagtcttgcttggttgcccaggctggagtgcagtggtgtgatctcggctcactacaacctctgcctccaggttcaagctattctcctgcctcagcctccttagtagctgggattacaggcgtgcgccaccacgcctggctaatttttgtatttgtagtagagatggggtttcgccatgttggccaggctggtctcgaactcctgacctcaagtgatcctcctgcctcggcctcccaaagtgctgggatgacaggtgtgagccaccaagcccagagaataccacatttgtactgttccttttctgtgtttggatacctagtgtaccactgggttctagctgcctgtgggagtcagtccagccacacgccgtacaggtggtagcctgggaaccgtcggctacaccagggttgtccaatcttttggcttccctgggccacattggaagaagaattgtcttgggccacccagaaaatacactagcactaatgatagcggatgaactaaaaaaaaaaaaaaaatcacaaaaaggtctcataatgttttcagaaagtttacaaatgtgtgccaggccacattcaaaggcatcctgggccggggttggacgagcttggatgacaccacacaacctgggtgtaccgctggcactgaggtctaggtttgtgcaagtccacccccatcgtgctcccacagccacggcaccagctcccgtgcgtttctcagaacgtgtccccgtggttaagcagtacatgactatatattcgtttatggaatggctctttctaaagcacctactgtgtgccaggctctgttgtgggtgctgggaatagacctgtggacaagacggccaagcacctagtcctccctgcggggagacagaccatgaccaaaagtcagtaagtgcgacgcttagcgggtctcttggtggtgagcaccaggctgaggaacaagtggtgaaggggtctggggagcctgtgggtgggctgggggttgcagtttcaaagtgggggtcagggtaggcctccctgagaaggtggcctttgagcaaagacctgaagtaggggaggaaggaagcatgtaggtatctgggggaagggtgacccaggctgagggaacagccctgccaaagcactgaggcagcttggaatgggcctcccgggttgcgcgattctgagttacctcgggggagttttcctggaggaggcctctttacttcttcctgagcctttgggggccccccactaggcaggagggaagatcagccctgcaggtcatctgcttcctggggctgggccttgggccctaagccctgggcctcacaaccaggttttgtcttggagggagcaggggaaggaggattgggatttggaggtaggagaaggaggagtgggactggggtgggggaggaggagtgggatttggagggaggaggggaaggaggagtgcgatttggaggtgggggaaagaggagtgggatttggagggaggggggaagaggagtgggatttggagggaggaggggaaggaggagtgggatttggagggagggaggaaggaggagtgggatttgggttagggagggggaaggaggagtgggacttggagggaggggggaaagaggagtgggatttggaggtgggggaaggaggagtgggacggtggcggtcccccacaaagtgatgaactcagcagggctttctgcctaggctcatggggctttgaagttggaaggaaagcggcctggtctgggctgtttttcccagcctcctcctcctctgcctcgctgtcccccgtccatcggcgtctccgtctccggcctaatggggagccttcctcctgtggctgagttatctgcttgtcatgccagtggcccacccgaggacgataaaagggctttttgtctgcaagcacttagcttcctctgccggggcgatccatcacatctgagggaggccgggaaggcagacagacggtggagtggggcctcctcctcccctgctgagggaacctgatgctcccaggagcccccttgcaggacccaagtggctcctcagcccgaaggcaaggcctgtctgggggccagcaggggtgagtgggagtggggccatgggggcacattgaggcaggcagatgctctgcactcccctgacagaggacagacgctgcccggatgccctgccccaccacacccacttggcagctctgtggggcccctctgggaccctccatgctggagagggtgggtggggggtgcagccttttctgagtaagaaccgtgatggtagaagggggcatgggggagacaaggggggacagacctcagggccgacactcgctatgcgtgcactaagcactttgtggaattacctccttaaatctcagggcgaccctggaggtgggcaccgtccttatccccattctccagatgaggaaactgaggtacagggaggcgatgtggcatccccagggtgcagcagcagagggagggcttggctccaggctcccagcggtacactcttccctgcggacctaggaccttagaagggggctgtgggagcccctggccccaaaagtgggttgcccgtgactcgaaactctgtgagtggattcttcagctgggagtggggtggggaggtgggtgtctgggattgtctatacattggggtgaggggtccggtgtgggtgggggctggggtcacggggtaccctgggcgggtgatcggggacaccgaaggtgtgtagggggaggttttagggccctggcccagtgggatctcacctctcgggggctctgggaggaccggctttaaccccagttggacggggccctgggccctgcttgggtggggaggagagcaattcagggccccctgcccttccctgtctgcgccaccacccttccctctctgccatcctcctctctctccttcccagcctggatgctcagccctgggcgggggctccctgcaatcccttcctcccctcccccttccttcctgctccctacccctccttctcctccctccttctccccacaggccaccctcaaatgacagcaattaatggtgcctgtgatggcgggctgagaggaggaggctgacagttgagcgtgtctgcctgcggccgcccgctaatcgggcccgggggatgcccctcctgccgttggctccaggcgcctgccctgccatcactcagaggggagcaggagccctggacaggcctgtgggagctggtgcagagcccccatccctgcagccccctccctgtccttctattattattatcattttctttcataaacgggtgggctctggctggactcttgttcagcatgagttggtggatgcctcccagacgtccttctcctgaaatgacctctcatgtgcctgtgttgtcctcagggccagccatccccacagggccccatccttttgtccctgcttccctgggagaggcgggttgggtggagcccaggaaccgtgtcctgtccggacagcaggcatcagttaaatgccccggcctgagtcctcggggcctgggggcagctatttgagcccagagccttgtctggtggggtgaggaagtgtgttgtgtttgtcagggttacaagaatcctggccagctctgtccacagtgggcctgggcttgaccatttatcacctggcagcagcaataatgaagcccctgctgtatgctggggcctgcagctggtatgttcactttggttcattttacttggcagttttctgaggagtgtggtatttctcaccttgcttttgtagagggggagactgaggggcagagaggcaaagcgatttgccctaaggggcacagtgccctacgtgacctagctagcataggacaaagctggggttcaacccagacccaaactgtccaatgctcatacatcaggggactttgggaaacttgagggccagtttaggaaccagcagactgatttagaagtgaggaaatagtccctgggtactgggaatggagtgagtagtgttaatatatgcatctctctccctgttccacttaagatcatcttcattgagatgtaattaacctataatgatgcacccattttaagggttcaattgcatgtgttttgacaaatgtaaacatttgcatcacctccacaatcagaataaagtgtttctgttccccccaaatccccaccagtcccttggcactaaatctctagcacccacctccaccccccacccccgactagaggtacccactgatctgctgttatagaagcttttaactcttctagaattttataataaaattatcattttattatatactatactttgttgtgtctggcttctttcactctgcataacccatgttgctcatgtatcaattcattctttctcatggctaagtagtatttcattctgtggatatattacagtttatccattcatcagttgatggacatcaaagtttccagtttttggctattgggaataaagctgctctgaacattcttgtgtaagtctttgtgtgaacatgttttcttttttcttatgtgaatatctaggcattgggttgctaggtcacatggtaaatgtgttattttagtttataagaaaccaccagctgttttctaaagtggctgtcccattttgcatgcccacctgcagtggatgagagttccagttgctccccatccttgtcagcacttgctactgtcaatcttttaatgttagccgttccaggagaccctaatgcacatgcgattacatttttcagcttttgctgccttttgggcaaagctgtggttctgtgttttgattttatgtgtctggccagctggtgggagtctaaaggatggtgggagataatctcgtgtctgccaacgctagctctgtgttttcctttctagtctttatgctgctgactgactgcttctcgtccggctgcagtggttgagaccacagtgcagtgccggattgcaccagttgggttgtttggggttagttagctgtgagtgttgttatttatttttttattttttattttttttgagacagagtcttgctctgtcgcccaggctggagtgccatggcatgatcttggctcactgcaacctccgcctcccgggttcaagcgattctcctgcctcaacctcccaagtagctgggattacaggcatgcgccaccacatctggctagtttttgtattttttttttttagtagagacggggttttgccatgttggccaggctgttcttgaactcctgacctcaggtcatccacttactttgcctcccaaagtgctaggattagtgagtgtttttttttttttttttttttttgagtcggagtttcgctcttatcgtgcaggctggagtgcaatggcacgatctcggctcactgcaacctccgcctcccgggttcaagcaattctcctgcctcagcctccctagaagctgggattataggcatgcgccaccacgcctggctaattttgtatttttagtagagacggggtttctctgtgttggccaggctggtctcgaattcccgacctcaggtgatctgcccgcctcggcctcccaaactgttgggattacaggcgtgagccaccgcgcccagaggtgttgttcttaacactcatcttacagatgaggaaactgaggctctgacaggtcaggtgacttccattccgataagaaatgaaactcatgactctgagttgtgtgccctttctcctccttcaggctaggaggtgccagctccgtttgttgcagtgatgtgtttgccagtccagagggtcatgccaagaattggtggctggttggggccaggaccacctttttcctagggtttcctctgctggagagatgagggtgtggaggagacgctgtgccttccggatcaagcactgtcctttggcactgagcactgttgagtgaatgtcaggcgttggttctgccaagggtcttccttgttcaatcctgttgtcttgggcaaaaccacacctgccttccggggagctattttggggcaagggaggagcatggcatatggaagcccaggaatgggctgggatggaagagggggcctccttctcctttttccttgcctgaggggtgtcagctaagatgacttttcggggaaggaggcctgtaaattaaataagcaatcccgtaaataaataagtaatgaagtcagcggggtgcctaattacatcagattcatcattgtggatggatgcctgcccggtcattgtacttgtttttaatcttcggctctgacatgtgtctccttccgtctcatagtcatccccaccccagctggagggaggaggcggggaggcgctgctgtaggggcttccagagagccttggtggtggaggtggtggtggggtccctggagggttatttacccagtctgcctgtttatggcagtcgtggaagggatgacgtctgttccacagtgaaacctcaggaggcctcgggccatcctgattcagcaaatccctcatcaggctgcgctgaagggtagatgacaaacatggtgccccgcacagatggggccacagcacacgcagcacgccctggagggcgagatgggaaggacacggacgggggcagatgacctcagtgcaaagtcccagggatccaggtggacccgtctttatgctgcagttgggtttgtaaacctactggagcttcgaagtgggagcaccccatggcagtgacagcagcagtcctaacagggtttgtgatcgtccttgtgtcacacttcacatgttataatttatttaattgactgggcacagtggctcacgtctgtaatgtaatcccagcactttggaaggccgaggcaggcggatcatctgaggtcaggagttcgagaccagcctggccaacatggtgaaaccccgtctctaataaaaacagaagaattagccgggcgtggtggcgggcgcctgtaatcccaactactggagaggctgaggcaggagaattgtttgaacccaggaggcagagactgcagtgagctgagatcgtgccactgcactccagcctgggcaacagagcaagactccacctcaaaaaaaaaaataaataaaaaattatttcatcacctaaaagctcttgtaaagtagggattatcatcatcccctctttacatatgaggaaactgaggcacagagaggttccgcatcttgcccgaggtcacacagccagtgaactttgcactcaagtcatctgcccccgtctgcgtccttcccatctcaccctacagggcgtgctgtgtgtgctgtggccgcgtctgtgcggggcgccgtgtttgtcatctacccttcagcacggcctgttcagggatttgctgaatcaggatggcctgaggcctcctgaggtttcactgctgaaaagatctcatcatcccttccacgactgccataaacagatgccattctgaactgtaaaataaaatcatgtttcactaaggacaaagcaagcccatttgctgaaattaaaatagcttctttccagatcttctctttctctttcagcggccctgattggctggctcttgggggactctctgtcctgcctgagataatggtccttagacccattgtacagttggagaaactgaggctcagggaggtggaggagcatgagtgagaccacacagctgggaggtggtgaagctgggattctagctgcttcttactgtttggtttggggagcgggggccacctcatgtgcctgacgtggaaggggctgcctgtcctctccgagaagcgcagggagctgtgtgcaccccaggctggctttgctggggttcttgctgtggctgattggttagcgtcctgtctgtccgcgggggagaggagaccagctgccccacctcgtggtttctcctcaggacctgagcatgtgctgggcatggacagaggatgggggtggctgggggcagtcttgtcctcgttcgctgtccatgcagctccagggtgcccagccacagcccacacctgttccctccatggtgcctctccatatctccagactccaggtcctgtacgaggcagtggggcctgaacccttgggatgtctgggcctctactgggggcccagggagggaacaccctttactttacagggtgtacttgtgcagccggacagggcctgcgttgctgggccgtggcttggatgggagtgggggttcacacattcccctggtgctgacttcaggcttgcggggtttggggctctccctgcccctcactgtcacctggggtggagagaggagttgaggaaagacccacatgaagaattgtgtgtgtccatggtgttcctgggggttggagcaatccaaggaggctgcctggaggagctggaacactcacattgaataatcataagcccatcttggagggactaatgtgtgtacatgcttcaaacaggacctggcacagagcaaataccatatttaccataaaagctaacatttcctgatccttttcttgcctcagtgctgtgtgtgagttgccagtattattattattaacattaactacaatttctaacgtgcaccccatacatacacgcatgtactctttgcagcagccttagaaggtaggtgctattatgatcagccctgttttctagttaaggggattgagggcagagagaggttaggggacttgtccaaggtcgcccagttggcagagctaggatgtgaacccagaacgcctgactccacggcagctgcttttcatcgtgtggatggtgcaggtgccacctgcagccctccctctgccccgtgggtacgccgatcactgccgcagccagcctggatctcttggcagggccatgccagctgtgggacagcctccatgtgccacgtagggccctcaggcacgcagcagctgctctgggcagtgtgggatggtcaggacgtgggacatctgcttcctgcctccctgcagccagattggtgtccccacggcctcctcctggttgaggggatggcaaacagcaaacaagatgcggcgctttgccttatggatcacacaggctgatggggagatgggcagtgccaaaaaacaaacacgattttgcaaggcaagaaaatgctgcctgtgaaataatacagggtggggaggtagggatgacttcagtttcgggggactcattttaggtaagaattccagggtagcttctgaggaggtggcatctgagctgggccctggacaataaggaggcacccactatgtgaaaggaagggggatgagggaacagcaggcgcgaaggccctccggccaccatgtttcaggcatgctgattggggttctgtgcctcagtttcccactctgtaatggctggagcagagcaggggggccccaggagggctttcctggatctgagactgtcctgcagacctccagggctgggctgtttttcacatttaaggcagaagtcaaatttaatgacttttgcctttcccttttgttcttttgctccatagttaatttccatgtatttacatggttttaatttacatgtattgggcacgtggcatgttccggactcatgtacgtcactgggatgagaatggtggagaagttggacattgcctgtgccttcgagtttagtatccagagggggagtgtcagttaaacaagcaagtgctatcgcgggtggtgagggttgtgaggacgaggttcaggcattcacctgggtgaggcaagagctgaattagtcttccatcaggccaggcgtccagggacgagtcattcaaggggagacctgggggtgattagttaggggcagttagttagggctcctgagttgtggcagagacacactcgagccgagttaggctatgacggggagttgatgggtcctcagagtggccagggtaggacacgttcaggcacggctggatctaggtgctcaaacaatgcctctgggagctggctttgcctcagctgtgcctccttccatgcgggccttgttctcagacaggctcatgccaccagcccagcccagccagccaaggagaaggagagtcacctggcatcccaggagggacactcctttctcttgtttgagtgaggtcctcgacatttgtttcactgtttgcaacagcaagaggaggtggccaaagaagggataaggggatgtcccaaactcagacacagggaggaaaggagtgagtgagtcagtgcaggtcaaaggggaggagtggggattgtggctaactggcatgctgggtattctgatggttttccaagagaagctggaaatctggattttataaggaatggcctagtttttaaaaaacattgaatgggccagaacaagttttcttcatggccacaactggctgtcaccattttatagcctcttcttagcagtgacttttaaagtattttgtccccactgtgatctgggtagaatgtcccatgggctgttccagaaggtctcaagtcttgggaagtcacgtctgacaccattggagatgccatttctgaaagtcaaggcccacggccacagcagtttctcagagaacaataccatgtctccagtggggcctgacattcttggagacagtatagtctagtggttagtgtcgtagatgcgggtttcacacttgctgagttcaaaaccgacattgccacttcccagccccgtccccttgggcaagtcacttcactgctctctgcctcagtttcccagtatgtattaatggaatgggtatgacagcaccccataggattgttgtaaggcaagcttgtccaacctgcggctcaggacggttttaaatgcagcccaacacaaatttgtaaactttcttaaaacagattgtttttcggttttttgttttttttttttttttagttcatcagctatggttagtgttagtgttatgtgtgatccgagacagttcttttagtgtggcccagtgaagccaaaagactggacacgccggttgtaaggcacagtggaggccgcgtgaagcccactgaccctggcacactgagagcttgagtgatgctggccggcgtgatgtgtccttcccgggttaggtccctgggatccagctggctggcgtggagcattcctgggcactcctctttcctctgccgctgcccctgccaccggggtgtgggttcccaggagccccagaacaggcagccacctgccccctgcccccagccgtccttgccagttgctgggtgcccatggtattctggcgtgccggatggtgctgcagttggaagtgagtcttgagtgagcaattaactctgccagctgccagctcacagctgctgtgggtgggggcggccccttttaaaaataaaaacaacatgcagaaaaacagccctggagtaccgttggcttcccttagccaacgtggtcagggcttcattttgatgcttttgtggagaagaatcccgggcctggatggggaaataggatgcattttggtctggggagtgtctttatttaggggcagaggtgatggcctgtgtctggcctccccatccaggaggcaggcccctttcctcaagctgcccacgagtggctggctcatggatgcctgccacagggaaggggatttgggttccttggggccagtttttagcaggctcaggccggagagggtggctgtgggacctctcaggtctgtttccagctctgtcggctataggggggccctggggccatcccggagatccctggagctctcctctgcagcttccagccagttttctggaactagcgggaaaggaaaggggcaccaaaggtgtttccgggcatgcgactgctgccactttgaggtcttggctttggtagtgggttgagtcatggcccatgaaacataggtacacttggaaactgtgaatatgaccttggccttatttggaccacaggtcttcgcagatgtcactaaggtaagggtctcaagatgggatcatcctggaataggatgggccctaaatccaatgacaagtgttctaagagaagacacacagcagagaagtccacgtgaagatggaaggaacgccaggagccactgggaactggaagacacagagaaggctccccctgcagagtctttggagggtgtgtggccctggtgacaccttgagcttggatttctggcctccagaactgtgagaggataggtcgctggtttcagccacccaatttgtaataatttgttatagcagccacaggaaacgaatacagttgtgaactttattttaatcactcatgtattttaaaattaaaatgtaaaatgtaattttgtcttgttcactgccatatttccagtgctcagcacatacagtaggggctcagcagatgcttctcgaatgtctgatagctccaggcctgggtgaggaactcctacctgctgggagttggacccagctttcaggaagtcggtaaactgggctggagtggtgtgcattcagcaacaccatctttttgtttatttatttgtttatttgagatgcggccttgctctgttgcccaggctggagtgcagtggcatgatcttggctcactgcagcctctgcctcctggttcaagcaattctcttacctcagcctcctgagtagctggaattacgggtatgcgccaccacacctgactgaattttgtatttttagtagagatggggttttgccatgatagccaggctggtcttgagctcctggcctcaagcgatccactgcgcccggcctatttattttcagttgaggtgaaattcacatcacatataatttaccattttaacatgaacagttcatgagttcttagtacaatcacaatgttgagcacccaccccttctatccaaaaaatgtcctcatcaccccaaaaggaaccctgtaccggtggggtcactccacgttgccgcctcccgcagcccctggcagctaccaatctgccttctgcctctgtggacttacctattttgggtatttctcctggacggaatcgtgcactgtgggttttggcttctttcactccgcacaatgtgtttgaggttgatccgtgttgaatggtgtgagtccttcattcctttatatggcggaattccattgtgtggcatacatcaatagaaccatttgatatctaagtggcttttcagatgaggaaactgaggctgcccaggtcacggagccctggggcccgggattgaggaggtgcagatagccagacgtgtctggctcacggtgctgtctctttctcctgcccccaccctgctccactcgtatctgtgcctggccaggaagcagcagtgtgtggggaggaagtgagtgggggtctcttccagctggagccggatgctgaagcgtagctgcggctgtgggtctggatctggtcctcagagttctggcccccacctcccccctgggccccacacatgtagtttctgttgacctgggttgcgagagaggcagcaggcaggagctcccccattcgccagctgagccttctgatgcctcgagaggctgggggccttgcctggggccactcagcttaaggtccccctgcccctttccagaccccctttggcccaccgtcctggcccctgtggcctgcggtgaatcatattctggggggtcttcaccgatctttcccaccgtcaaagctctgctcagcagacgggctccaggaagcggcctgtcggcagattttggccaggggatgctttttcgaagtatggaggggtggtcgccgtcgaaggcttgcgtgatggggagttcttttgctgagcagataaccagacactggcttattctgaatatgagtttggttttggccacaggctctgtctgggggctgctgcctgtggctgtttctggtgtttgatgatttgtggtcttcattaagtcactcaacaaacaatttgctgcggagtatctggcggggaaggcacaggaagcagaacgagtggccgtgaagagacatgcccagtgtcaaacctgcccatagcacacagtcgctctgagggggtgggaggagttaccgtggattccagggccagcctttggcgaaggtctggatgcaggtctgtgtccaaaacaaacaaaaatgaacagaaggaggtggtgaggcctgactcggccgctctcaggcaccgcttcctggtggtgtttgcatggggccagtttggcctgggtgtcatggtcccgcctggtcttggcgacggtctgggcgggaagatggtgctggatctttgggctaaaaatatgcccgtgccttcctgtgcctcagtttccctacctataaaagaaggcgtaagagtagcagaatcccacctttggctttggggcaggtctacggaaaccccccaggggtgtttcctggggaaggctagagggccagctgttcacaggagacatctggcttccaggggcctccgcagccactatgctcatcccctcgtggccagtctgggccccctgccagtccagtggccacgggcccctgtcacaggcaaatctggtcttagtcctgaaaccctcctgtgactccttgtggctgaattaccacgtggatagcggagacaagccaggcttgcccagttcaagtcccagctcagccactagctgttgaccttgggcaagtcacctaccctctctgggccagcctcctgctctgtctgtgtgtggcggctcaggggcatacctgcctatgctgcggtggtgtgaggccagctggtgaaccaggggacccgcttagcacagtgctgggcacacagtccgagctgctgggctcggtgtgtgtggccactgttattgttattaatattattactctcaagatgctcctgagagtaaaaaggatgacaatgttattgctggagttgaaggccaggcccagagtccatctgaccacttcccctccactcctattagctccctgacctcatcgtcaaactctccccgcctcgcccctgcgccccggccacaccagccttctctctgctttgacaacacacccgcgtggtccagcctccagaccttcacatctgccatgcttctgccaggggtgccttcctcacatctgcacccccagacccttgtcatcatgtgggctgctgtccagggacacattcttaggcccaactcttggctgctaggggcagggaagtgaatctggagaccctggtggagcctcctctgcctcctgggagctccagcagcttcctctggcgcctcatctctgctttccagagcacttggagaagcagagctcagcctgccccttctacggatggaaagttgacacccagagaagctcagacttgtctctgagtcacacagctaattgcagccaaggttcagactcctggctgactaccaagccatcattgttggcctgtgtgtgtgtgtgtgtgtgtgtgtgtgtgtgtgtgtgtgtgtgtgtgtgtatgtgtgtgtgtattatttggccacgtcttcttttctaggcctgtcaccgagatgaccccagatcagaatgccagtgtgagggggtcacgctttcttttcctaggattaaaaggaggacagaaatatttgcaagggagagcctgctcctctggccatctggccctcgggacagaggacgggggagggatgggccgaggcctgggttcggaaccaggccggagccaaggcgccagagctacgctcaggttggaggtgcaggtgcggctcgaagctggacagtccgggctgggaggaagcgggttaaagtgggagaagcggggctggagctctctttcgcctgccagcgagcgaagagccgagctataaaaaggcctcacagtgtttcagctcccgagtgtcggctggaagcccgccagggttaccatggcgatgaggaattattacttactgccaaggctgggagaaaaagctcgtacttttggcttccaaacaagaggagtggacttatgtaattccctgtgtttataggcccagagtggcagaggcgagaacggatcgctggaggcccgacgtctcgttcacggcccagccgtggggtcaggcggccccgcacttgtcgccggtgggccttggcctgcccgggtttggggggcatcgggctgggagcctggggggcctggcctggccctgcagggcctccagggccgggatgggagtcgtagtctcgcgggaaggtgaggccgccctctggggccgcccctctgcgggtgtcatcctggaggaaggatgggtctgatgttggctgtggtgtgcctcctggaagccggcagcacagcctgtgtgtgtggactctgctggcccgctggctggcactttttttctttttctttttttttcttgtgagagagttacttcaagttgtgtttggagctgacgtgagcgaggttggtcatgtgctcgggtaagagaagtcgccgggcttggagtgggcagggaggtgcagtgtggctgggtcaccccggccgggggaggtgggcgcagactggggtggggggctgtggcctgcaggctctatgcaggggcgctgattgggggccgaggaattcatctggaaagagccctagttctgtcgctggaggtggtggccagggctgggggctgagtggccggccgcaggtcagccaatgggggcagctggaccctcccctggcagcgcagtgttgtcggccctgagctcagcgggatggtgggcagggctgtctcatcggacgaagttgctgcagtcacggaaaagagcgctcggaggcgctggccgggcaggccggggtgaggcttcttggccggcccgcgtgggaggggacccgggtgggcactgtgctcctctccttggtgcacatccggcgtccctgggggggagcatggcgagccttgggggctcagggggcttctgttcccggagttgacttcaggagggcatgtgatcgtgggcgctcccgaggctctgccctggggctccgcggtgggctcaggcaggggagagccaggtgcaggcagcgctgcagcccggccccggcgcccggctccccaccgaggtggcgcttggctcggtgcccatgtctggtttgaaatcagcgccaccggcccaggcttgcccagggacttggcagcgaggagccgggataaacactggaaagttggaagggcttcccgagctcacaaggagcctttagttgcaaaccggggggatgagggagtgatttgtcctgaggtctgggtgcgccgcggccatagggaggtggcgggaatggctcctggggacctctgagcccaggctggggaagggagggggctgggcttccaggcaatgttgctcctttgccacagacctgggtttgagtcctggctccgtcctctctatgctgtgtgaccttgggcgtgttgcctcccctttgcagacctcagtttcctcgtctgtaaaatggggcacagtggggtctacacaagcatgggactgacgggagaaggagctgcagttttagggggaacgcggggcagactgcctgggttcctgtcctggttggacacttcctggctgtgtgaccttgggcaagtcacttactgtctctgagcctcagttttcccatctggcaaatggaagttgcatctttccccacctcataggctgtatggcttaagggagtgaatgaaacctgccttctagctcataataggctcacagttgataattcactggcactttgttttctcgatgctgacaataccggcacctggtctgagggtggggggcccctgggatttcagcatctcagggcgatggtatttatgaagttgtagtggccggactgaggttccagtcctggctcgacccctcaaggatggtgtgaccttgggcaagtcccggaatcccacagagcctcagtttccttgtcctttaccacagtggtagcactgcagcctgccggtgtgtctcgggagagcctgagagaagcctgaaggggcccgcacagtgctggcctgggtgggcctccgtaattgtaaccacaaggttggatttaagttcgagttccgtccatttttcttttcttctttgcagagagctctcatgttttgtagaaacctgggtccagataatgggaggtaggtcgagtgggtgcttcccaggctctgcctttgtttgggatccccaggtctccccccatgcctgcctgttctgccccgtctcccactcagcctgagcccctccgtgccagccctgggccaggcaccccccacagtgcctggtgtggcctggggactggcgcgggagggccagttctcctgcagaaggtggcagccgtcctgtgtttgtaagtgacaccggatgctgggccagtgactggctcagggcctccgctcttgggccagcaggagccagtggggagttccccgggcgtccaggccccccgcaccagctgcccgctgtctcattgtcatggggcctctcctgggacctcgagaatggcctccgaaggcgggggggttctcatccatgtccccttgtcacccccagggccttggtgtccacttgggttggccacagagctgtgtcgtggctgcccctgacctttgccaaagtcctcagggactcgattttcctacccggtggagaagagtcctgggtgaggttcagaacagaagtcagcaccagggcctttgtgacgaggcagctcagcatggactggttgtgatcactggagtctgcacatgtgataagaacacatagaactaaatacgcgcacactcacacatgcacacacatacatgcacactcacgcacacacccacatgtatactcacacgcacacttgtgaacatacacaccatacacacagtcacacgaacatgcacacgcatactcgcacactcacactcacatgcacacacactcatatgcacactcacagtcgtgcacacacacccatactcacatgcagacacccacacagatacatgcgcacatgcacacacacactcacacaagtgagtgcattggaaactgctgcaatctgcatacggctggctatatccatgctgccttcctagttatgatatggatgatgaattgtcgttgtctcaggtttgtctcaggatgttattcttgggggaggctgggtgaagggcacacaggatcctgggatcttgattttttttttttttccttttttgaaaccgagtctcactccgtcacccaggctggagtgcagtgcagtggcacgatctcagctcactgcaaccactgcctcctgagttcaagcgattctcctgtcacagcctcccaagttgctgggactacaggcgcatgccatcaagcccagctaatgtttgtatttttagtagaggactcccccatgaagctggcctgtaactgagcttggtcccttggacatcccagggggtccaggcagagtttgctttgtgcctcaggatcacagagggctccagagcgtcccaggctgggggacacgtggtgcctgcagggcctgtgggggcctcatgactgagctgctgtaagggtgttcctgtcatcagagtggcgtggtggaggcttgtgtcccgtgggcatgggtcgtagcttagggtctggagagatgggggtgggatagggtttgggggcatccagcctcatgagcctcttctttgctgttctttggggcccctgatcatgggcctgcctcaggacctttgcactggctataacctttttttttttttttttttgagacaaagtctcactcccgcaggctggagtgcagagctgtggccacctttctttcaggttcaagcgattctcctgcctcctgagtagctgggactacaggcgcataccaccatgcctaatttttgtattttgagtggagacagggttttgccatgttagccaggctggtcttgaactcctgacctcaagtgatccacctgcctcggcctcccaaagtgctaggattacaggcatgagccaccacacccggcctggctgtaacctcttctgggaacaccctttcctgagaccttcagcctccctgatataggcctctgctaatggcgcctcctgagagaggcctgatgtcagttgtgactccctgtgacaccttcactactccttgtaacactgtcaccaccagggtctgcggtatgcccatcacccctgtccccaccttgttttagtctatttggactgggtggctcacaaacaatagaactttattgctcacagttctggaggctggatgtccaagaccaagatgctggcagatttggtgtcacatgggacgagggcccgtttcctggttcatagatggtggcttctcccaggaagaggggcagggcggctttctgggggcaccaatcccactcatgacagctcatcacctcccagaagccccacgctctgacatcatcccgtggtgattaggtctcaacatgcagattttggggggacataaacattcacactccagcacccctccatccaggattttgttcatctttgtcaccgctgtgtccccagcactgggtatgtagcaggcacttaggagacagttgtgcctgactcagtgtcttccacggggcctcagcctgtcccctccccataaatggggcctctctggtgaaggaggccctgcattttggggatgatttggaaaaccaggaaaagttctcatgctttttctctgactgccactggggtacccaccaagcatcccaagagagctacccctcctagatacagtcatgagaaggaacccagggatgctgtaggtacggggagtgggggaggggtggtgacagcctcagccttgtgtgttgaggaccaaggcgaggtgagcattccacataccttagttcattgtgtccttcccatagccttgtaaagtcggcacagagtcaccctctcctgataaggcacagagagggtaggcagcttgctcaaagacacacagctgcaggcctgcagtattaccaactgaatggcatttccaaggcagttgcttctttgctcaaggtcatgcttagcatgttaaggggatcatcctgtttcatccccaaaagtccctctactatccctatcttccgaggcgggtcctgttttctggggatctggctcagaactggcagggacccgtttcccaggctgagagagtgcgcctcatttagcccagagcagaggcccagagatgcccacacttctgaaggttgggggtcagtttccagtgtggcttagaagttagagggcaggaggggcaccccagagtggaggaactgccctcttcctccggagtcgttcatttgcatgacaatgagccctttgttcctgaggccagcctccttcccaggctaataacataattcctggcctgtgatgtcataatgggccctttctgtggctggggtcagaggctgggtgggcagctgtgtgggctgggccaggcctgctaataaccagggaggtggtgattgccaggggcctgtgtgccaagctgcctccttccagggtctcgctgagtcctcccgagagagcagcgggaggtgggatttgctcccctgttgacactggagcaagctgagcctccaggaagccctccctggccccaccgtttgtctggtccccctcgatgagctgcttcaagcttcttggcctgtggagtgggggtgactcactgtcagtttggccctcggccgagaggcgtgggcgtgagagtcccttgtttcctgtaaactggagggaggccaatacccagcggctactgtgttggggccactcggaaagccaggttcaaaccttggccccacttggtcccctgggcatcggctgaactccctgtgcctccgtttccccctctgcttcatggggttccgctggggcttgggctcagagctaggcagggagtgagctttcaggaaatgggcaatgtcagaaaaggcgggggctggtggagtggggtgagtggtgatacccccaagagttaggtccatgtcctagtaacccagcccctgtcagagagagaccgtatttgataaaagggtctttgcagatgtgttttgagatgagctcatcctgggttacccaggtgggccctgaatccaaagaccagtgtccttagaagagacagaagaggagagagcaagactacatgaactacaggaagacaaaggcagagattggagggctgaagccgcaagccaaggaatgcctggagccaccagcatctggaagaggcagaaaggagcctccctttgagcttctggagggagtagggtcctgctgacgccttgattttggacttccaggctccagaactgttagagaataaattgctgtcgttggccgggcgaggtggctcatgcctatagtcccagcactttgggaggccgaggtgggcgcatcacttgagcccaggatttcaagatcagcctgggcaacatggcgagaccctgtctctacaaaaagcacaaaaattagccggatgtggtggcggcttgcctgtagtcccacgctgaggcaggaggatcaattgagcccaggaggtcaaggctgcagtaagccatgattgtgccactgcactccagcctggaccacagagtgagaccctgtcaaaaaataataaaaaaataaaaataaatcactgttgttttaagtttcctggtttgtggtcatttttatggcagccctaggaaatgaacacagctggcgacgccagtctctggaggtgggggaactggccctggcgggggttggtactgttccccactccaagcctgagggtgcaggacaagtttgggtggccgagaacccctttgtgcctgggagtgcatgaagccccattcggggagtctggactttccaggaaggacgccttgctcgaacctgcctttcttgccgagaaccaaatccacaaggccctagaccccacctgccgcctgctgttcgctgtcccctcagacagccctgctaaggggacaggacccagaggcaggaggctctcggattctaccccggctttgccccaggccccggacgccctttccccacgcgtctggtgactcctgcagaacccgggttgcactcatcccccagcaagccccaggtttgccgggtgcccttgacaaatggagaaactaggcccagagagggcaggctacttggcagaggccacacagctccttagtggcactgacggccttacagtctcgccacgggggctggcactggggcttccaggagtggggatcagagttctcggccacttggagacctggagtggagctggccggctgtgtggacctggggtcagttacctgatatttgggacactcggctgcctttgatggacctggcctggtgtaggtggtaccccgaaatctgggctttaagcacaccctgtctgtgctctcagcctcagtctctctgtttgcaaactggtctttgagcttcagctccacgtctgcgattttgctcttagcatgttcatgcattcagcaaacatttattgagcacctgccatgtgcagtgtgctgggactctgggggacacaaaggtgtgactcttgcttcatggatcttgtgtttggggctgtggggggagaggaaatgcagcagcacaggttggagtccagattccgggttctgatgagggaggtcacggagctgggccgtgagggaggtgaggatgtggcctttcgtctcctcctgggcccggggtggacagtgtgcagcaggctctcaagtggacatggagatgcccacagcctgtccgcggcggcccatgggcacctctggctggcaggacctggcctggtcttgtgagcagggacatgggatgggagggctgcaaggcctggctccagcctggtgggagagacaacagtctcctctaacctaagcagcaggcatgggtatgctggtgacagggtcccaggacacagtgggtgagctggacacaggaggtggctcgcctgggtttgcatccaggctgtgcccttgttggctgtgtgaccttgggcaagttgctcggcctctctgtgccagtctctccagctgtagaatggggatgataacagaatccctcacgggggcgctgtgaggaaggagttggtgccaccaagtgttgtgttggggactggctgtgccagtggctgcgaggtgttccctcccgtggctgctcagggcagcggcgtggaagatggaagtggcatttgctcatcttcccgctgccctgctcctccctgtgcaaatagcctcagtcttccacctaggaaacgggagctgtaacaagcacatggccccatggaggtcgggaggagaagcggagctggggtgcatcagtgcctgtggggtgggggcttggggtcgccacctgctccagattgaggccttggctgcccccgaggcctggaacagccacttgttttacaacccaggaaactgaaggcctggcagggatggccccaagacatgcccatgggtacagcccatgtggtggctcctggctgcagacaatgcctcttttttctggcctggcgggagcagcccaggcttgctcaacctggcctaggtttatcagcacatttggttctgcggtgcggctagcagacattccctccaagagagatcgtgatgttcctccggaaaccgaggtccggaggctcaggttactgtggggggcggccgtcggggggtgtgtctgcctctgagaagtgacccagatcagagctgggctgtgctgggcagtgttcatctgcaaagctgccgcctgctctttcacccatgagagccactgacagctcaggaagggactgggagccacccactttcccttcagggtgacacaggacaggcctctccctggctcctgcctggccccttccccctacactgagtctggcctgggtctcccattccatttctctggcctcttcttggctggctttggacctgtcctcacctacatggataagggacctagcgggtggaagagatctgattccagggagatcctatctgagagtttgtgttttaggagggttgctatcttaggtctcttggttgcaatggacagactccctctgcctcctgcatttagcacaaatagttcaagtaactaaaaaacctcagagaagcttcaggcacagttgggtccaggtgctccccactttcagtccctgttagcctgagactaataattgcagttcagtagccccagtggaaggacagcttcttgttcccaatattccagcaaatatcatgggaatgagttttgttgcctcagcttgagagttcagagttaagcccccccccgccccccaccaaagccagtgccactttggctggagggctgggtcagcctccctgagaccccaggactgagggtgcagggggggtggttgcccagggaaattggggtgtggcatgcacggagtggggccgggtgggcagagacactgtgtcttgctccctgtgttggagatggggccaggttggggtccctgcctggcctgcctttcatggccagtgtgtgtgtgtcccattggggtggagcaggtggcgccgatgagtcactgggtaagtttcattcctgttatatttaatagttgagggcctcttgggtcccccctccaagccgttgctggcgctccacctcctgtccccccatcagcccgcttcagctccccagccttccctcacctctcttgtggcgtccagtgaccacgtcataagccacaggtcatgtcctggcagcccctgggctgtatttggctgtcagactgatttattgggttggttttatagtcagtgtttttttagaaatatcgggagatgtctcaaaattgggcttcttggctttgctggaaagatttggatgccgtggaccccctgccccacgtggaccctgttccagcagggtctggaacatcaggaatgtttgggggccacattcctgggtctctgctcagtgttggctggggctgagctgcggtcacccccttcctgcgggcccctcccctcggcgtggtgcctgcctgggcccttgtgttccggcagggtcttgggtatctacagctctcctcttgctttttgtccctgcccttcttcgggtggatcatccgatcccaggtagacgcttagcttcagccgtcgccactcctgggcgctgaagcatttgtttactgtctgagctcctggctgcaggggccataggaccttttgggttcttgatcactgtcccgtcatcagacatttattgatcaatgcccctggggtaattgaatggcccagatgcgtccacttctgagcattggacagagctgacgtaaagtggattcttcccgtttagcctgggagcccaggcggcagtggggtcctcccatccaggccctttgtggtccagcctggccacttgctgggggctgggatgggttggggaggcaggaggggacccttgttgagtgggtgggctctgtcgccctggacgctgctgctggcacagctattcttagcagcagaaacatttgtcctcattcacatgtggtggatgcctccagggatctaccctgaaatactagaggcgaccccataaattcctcagaaagccatccttgagggcctgcgtgcatggaggagaagcgggaggaggcgtttccggcagctgcacagctgtggatgtgtttgccagatgttggaggcagggaagtcggtgggaaccttgcggaggccgccttcacactcggggtctgggcatggacatgagcgggtgggacagagactgcagactggtgggcagagagaagggctctggccctggcctcaagttttggggtccaggggcccctctgaagcagtcagcccttccctgggccctggccttgaggccacctgggttggaggcagctggcgaggggagagctcagcttatcgggcgcttccgagggatcagaggtgcaagtcgctgcccagccatgccctgtggccgtcatggggtcctgaggtgaggtgggccagagacaaggcctggacgcatgctgcactcggctctgagggcctgctgagtgccggggccactggcaacactttgccttttatgggggcagcctgagcctttggggccaccgcggaacaacacaagcacaacactagcaatcagggaggtctccctggaggaggtgttgtttaattttaaattgtggtagatacatataatgtgaaatttaccttcagccattggtaagtagataattcagtagtgttaagaatagccatattgtttagcaaccgatctccagcacttttcatgtggcaaaactgaatcgctatatctgttaaacagtaactcccccttcctcgctctccccagcccctggtcccagccattttcctttttgtctctatgaattcagtgactctggccacctcctacgagtggaatcgcacagtgtttgtccttttgtggctggcttctgtcactcagcataatgtcaggagctgtgttccatgtagtctggggttgttggttcattcttagccatgaagcaaaacggatgaagacccaggaccccaaccccgtccgcatcctttagaaaccccaggtcccaccgcctctccaggtgctgtccaggagctcagccccagctcagccacccagctccctgagccccactctggcatggcctccctctctcctgccgtcacagcccaggggcacggggttaagtggtttgcccaggttacacagctggtgccagcgtctccctccccactgcccagacagcagcctcctctctgactcctcacttccctctgcagagaagattgctgttgggaaggccagatggaggagatgggtctaatggaaaacacgtccctcctggggcgcccggaacttaatgaggaagaggcggcagaaccaggcgtaatgtttgtgaagtacgcaagtggggagggccgctccccgtgcagggcttctcgggtggagccacaggaacctggagtgcagggagggttcgtcctgctgtggtttatctccctctcttccttttaaaattaaatggaaacaaaaaaaaaaggaggggaggaggaagtgattttgagcatacttcgccgtggcgggggagcagggccgagctggctgccgtccagcggacaggaacgctccaattatattggaaacagtaacgggcctcctcggaggctccgaccaacgccacttccctttctgttcactgagggcgggcgcctgggctggcagggccgtggggagggccgggggtttgggcacccgtatcctgactgtgtggccttgggcaagtcagttcacctttccgagcctcagttttctgatctgttcagtggggcgaattgtgtttggtgaatggaactggagcgtctgctgcctctggtgttagcatgagataaatgtggcctggagtggaggtggggcctgctttgcctggggtgaaggggtgcaggaatggggaagctggggggcttgaagcagaatgtggggaatgatagaggctttcccagtggccgaggagcctctctagaggaggggagagatggggctggtgctgggggtgggttttgcacctggcctattttcccctggaagcaggagcaggacgtggcactggggagacaggaataatgggctggggcatttgggctcacttgagaatcacaggctcctcccagactcagtttgcctatctgcaaggcgaagatagccatagtgactggcttggttaacatcatcgccatcacctccctccttcccccgagtggtcggcgtggcagagggcagtaacagccacgctctccttctgggggctcttctgtgggccgagaactgcaccgagattcttgtagctcttttttccagtgaatctttccaagtgaagctcagagaggtcaggacctcacccaaggtcacacagctgtggaagtggcggagttgggatttggaattgatcagcacgtgggagccctttggaatggcagtgtgtccacaggaggtggcttggttgagagggcactgactcgtttcagtgaccgaggggctcagcccacagcctccatagctcctgctcctacaggtgcagcccacagcctccatagctcctgctcctacaggtgcggctaaaactgccgaggaggagccctgcctggtgggggagacagcggtaaacaggtagctgtggcacagggggccgagtccatgggagtggcagggggagcgggccatggcaccggggggcccccttggggttgggggaaggttccaaggaggtgccagtagaggcaggagctgaaggctcaggagaagacagactgaacctgccccattgagtccaaccagccaggcagggcatgtaaacaaaggtagctgagtaggaggggacgtggcaaatagggaaagccgagcctatctggtgtagatagcctctgcccacttccagccggccatggctggaacctcagtttcccctgtcaaacgattttgtggtaaaatacgtacaaaatataccattttggctatactaaagtgaacaattagtttgcatttaggacattcacgggttgtgcaaccaccacctctgtctaattccaaaacagtttcatcctcccagaaggaaaccccaaacccattaaaccgtcactcccctctcctccctccccacaacccctggcagcctcgggcctttgttctgtcctgggaatctgcccctcctgtgaagttaatggaatcatgcagtgcgtggcctttctgagcggcttctttgccttttgtgccatgtcttcagggctcacctgcgttgtggctgagtcagcgcttacctttgcgtggctgaatcgtagtccattgatggacagactgcgtttgtttcatctgtttgtcagtagatggacatttgggttgtttctgcttgttggctgatgtaaatagtgctgctgtgggcattctaatcctttctgtttgttttgtcaccagttttccgttccttggggatgtgtagctaggagtggcatcgctgggtcatggggtaattctgggtttaacctagtgactgttttccacagtggctgcactgcacatctgacattcccacccgcaatgtgtgagcagccctcattaggagaagccagacattccaaatttcctgtgaaatccctctttataagagctggtctctggggcttagctgagctgaccctggggtgaggaagcaagtcccaggaaactgcccagagggagcaagtctgggacctgacgagacgctccgggcaccccagctttctggctttaacctggcccacgtatctctaccctgtacatctacccggggtcaaggaggaggattcccaggctggagtcctctcggcctttctcctcgaacccagctcaaggggaagatgtgctggtttatgctgaaaagggagaagtggtgccaggtgggggactcgggagagttgagaccctcccacgctgagtctgggtttgggactggaggcagttttccctagggtccttcttactcagcaggctgggacttggggagcagttatatgggtttgggggttcctgaaggcgacagtgcctttctgtgtccctcatggagctgggcatgtgggagggcctgggaatattagcaggatgaagacatgcttggccctggggattggttagaaatgtaagaccagaaaaacccggaaaatgaagcagctaagttgatatccatctggtgatgagtgtgtgcatccatccgcccatccatccatccatccatccatgcatccatgcatccatccgtccatccatccatccattcgtctgtccatccatccatccatccatccatccatccatccatccattcacccgtccatccatccatccatccatccattcgcccatccatccatccatccatccgtccgtccgtccatccatccatccgtccatccgtccgtcttccatctatccatccatccattcgtccatccatccatccattcatctgtccatcctctgtccatccatccatccatccatcaatccatcatccatccatccatccatcagtccatgcatccttcctcctttctctatccatgcatgcattcatccatccatcctcctttcctccctcccttcctcctttctcctccatcctcccatctctatccctcttccatcttctccctccatccagccaccccctgctgagcacctgggtggggagtctgccagttgggccagacctgtcactgggtgtgggccgtggtcagcagggccttttgccttttgtctgacttggtcactgctgtagctgtgcttgtacagtgtttgcacataacagatgctgaaataattctctaattgatgagaatgggtcagcaaccggagtttgggatgggtttggcttgcctggtctcagctggagggcagaccgcacccttgtgggtggcacctgggattgagctcttagtatttgaccctcagcccctccggcagagccaacgacaggctggggttgggtacctggctcttccttagggagtggaatgacctttctgccaagtgagggccaaggagtctggcctcattcctgcaggcctgccgctgtgcatgggtggaggcccgtttctctagggccctgacaatcgtggctgtcatcattcagggttacaggggcccttttacctgtgccccacactcagacacctgtgcccagtgctcctcgacacaggggcagctacagtgtcctttgaacacagagacgccagaggcagacttgccacaggagaccgcacgtcagccttgtttaaagtgcaccagctgtgtccttcctagctcccttgcagtgaacaccccagctttctggctatagccagaaagagtgacctcacatgccttcgctcaccccactctccccattcaggcctccctgctgtcctcacacaccaggctcggtcctgcctctgggcctttgcacctgctgtgcctgctgtgtggactccctcctctccccggcgcctttgcataaaaggcacctctggtgacgcacccctgactgcccactttcaaaatgtacccccattccctgcctgccgcctcctggttctgtttttctccatcgtgctaacaccttctgccatcctcttactcccgtctcacctgctggaatggcagcttcacgaggtgggggatttgggatcagtaattcactgctgtatccccagcacctttcacacagtaggtgcttaacaaatcgtggtagacagagtgagccaccaggccgggcagcaggagctctctcttcacccccttcctcattggctgtgggggcccctctggactgggctgggcgaggtgcacccttgccacgtcccaccggctttccgcatctcaggactcactccagagctggattcctgagcatccgttctgcgccaggagtcctgctgaaggtggccatcagatacttggccagttccccagtttttactgcacgccagaaagtaaacacccaaggtgtcaacagctcgacccctggagctggcgctccgcagcatcttgtgcgcacatcccagaactgctgtcccagagttccccccgggccggcttctcctcgggccagactggctgcagtggttttgtttagtaaatatttattagatgcctactgtgtgctgggctctggggatacagcagtgaacaaaacaagtatttctggagcacctcctgaagtaggtagtgttctcccttaaggtacgtctgcgtggaacctgggagtgcggccttgtttggaaagggtttttgcagatcacattagttaagatgaggtcacaaccggataggggagggccccaaatccaatatgacgggtgcccttagaagaaggggagacacagagacaggagatgcagtggaaaggctgcgtggagatagaggcagaggatggcacgatgcatctacaagccagggaacaccgggggttgccggggccaccagagctggaggagtgaggaagtaggaagggcctcccccagagcccccagaggccgtggggccctgatgacagctggatatggactcgaggcctccagaacagtgagacaatccatttctgttgcttgaagccatgcagtctgtggtggggcagccgagggcgctaatacgcctcgtgtgtgccaggtgccgtgcctctcggtggctgtcacacaataggtgcttattccacagtgagtggagcaaatacctactgagcggtgagggaggccgtatgtggctgagctgcagggctcctggggcctgcctgtcttcgcagggccaggctgggacagtggaggcacggcctgtgttcccgccgtggttccgcccaccccaggggggctttgtgccttgggcttctcagagtatcagagggttctgtcgagtgtgtgtgtgtgtgtgtgtgtgtgtgtgcgcgtgcacgcgtgcgcgctcgtgccgtgggcgctctctgcctggcaggttggtttttaatcccgaggctcccccacctgccacaggttcttccaatgtcagcacccattagttcccagaacatttcaggcacgtgcggcgcagagccccgcgtgcctttcatcctccccacagcccgcggctgagcgctccgggcacatcctgtagctcccacacctccaccagcccccgcctgcccctcaccctgaggctgtaattccaccctccccaggtctgaaccaggccgctcaagacacagaaaatctatggaatgtgtctcggtgtggcctcatcctgccggagctggagaggaatgcaggggtgggaggccccatggaagcttccagggcctcccggaaaggcgcctctgcccggccaggtgggaagaggacacaggtgtggtggtttctggcatcactgcgttgctggcatgcacctccgctgggcagagtcattcagtgtgcacctactgtgtgccaggcaccagaaggggctctgggtccagcaggaggcaaggcggacagccagtcagagctcacggcccgagctttccgctgtggatttggaaaccttaccaaagcccgcagtggccgggaacagggaatgtggcccacttggcttctgctgctgcccggcagagtgcagtgggggcggggggcacttgtgtgtttgctacctccttgcaggcatggcccagggacagacccctgcagccgtgcatggggagcccctccacctgcctgtgtgggatctgcagccctcctccagctggttcaggggccagcaggggccctggggctgtggttggtggcttggatgtgcagaggcctgcttgggcccttggtgtccccgttgggtatcccggccacctgagatctacaagtcccttgacctcacccaggcaccgtcttgttctcctcggaggcctgaccctcctgactctgcatggctgagcacctgctgttccccaggcacctctcggtatgccacaggcacagggtcctcgcagcgggcctgtgcagcgggactcctgcagcgagctgtttccgcggcctgcagagtcagcctccctcctgactttcacccacctgcccatttccccttctctgtcgctgttgccctgatcccccagtgtcccctctcttggacatttgcaggagcctccccaggtctccctgatccactcttgctgtccccagtgcctgctcgtaaaacactgaccctttactcgcccccgcaaccaccttctgtggctccccactgccctgagaacaaaatccatccttacccgggcccatggggccctgaatgactctgtccccacttccccccatattcactcaatgaatttctcaaacataaacggcacctgtgctcacccccaggccctcgctcacccctgggcctgtgctcaccgcctggcgggggctcacccccaagcctgcgctcaccccccaccggctggcgctcacctccctgctcttgctcagcggcgcctccagctggagcactctccatcccctcgccttcaccctctggaagttcttcttcctcgtatctcctggctctccccagggctgggcagagcccctggcctgagaccctccagggcctggaccccgctgggttcacaagaagtccccagcgctagcccggggctcagcagggaccacagtgtgtatgtaaataaatgaatgccgcccaccctttctgaccccaccgcagccagacgcagcggcgacatggggcgtttgtgtctgaattccccctccagcccggatccatcctcagaacctcctttggccaggaccagatcctggagaccctggaggggctccctcgtcctctcctgcccccatctttgaggaaatgatgtcatcattttttttggcattcacttccaaacctgctgatgaaaagtcaaagcttatttttttccctattcgcagtgctgcacacccgcctcctctatcaagtttcaaaacctttgcatcactgccctgtaaaaccctgtaaccattagcaggcctcattcctgcctcaccctgccctcctggtagccaccagtctcctttctgcctcgtggatgtgcctgttctggacatttcatatccgtggagtcaggcagttcgtggccttttgtgtctggcctctttggttcagcatgacattttctggttatgtgtggtgtaggacacagccgtccttcgttcctctttatggctgagtaatactccatcgtagggatggactggaatttttgctgggtctgccttttggctgctgtaaattctgttgccatgaacatgcataccgtgttttgtttgagtccctgtttccagttcttttgggtggatgcctgggaatggaattggtgggtcatatggttattctatgtttaaatttttgaggaaccgccaaaccgtttccctaacatttgttttttttcgagttggcaggaaacgtggctcaggtcgggaggggttggaaactgggtttcctaagctcgtggtgagtgagggtggcacgaggttactggagttgttccctgttcaggccccaccggcatgtgaggcgctgggtggggggctggtgggggaaccccttggtaggtgaggggccgaggttccagccccatgctccggggtgggcactgtgtaaatcccaggcagtggaaagccagccagccagctgcggggcactttaggacggtgtcaccctccctggtctctggtgcccgtgtgcaccatggtaagcgtgtgccaggggcctgtcacccccaggcagcatctcactgggcaaaggaggaaagaaaagctgtgggtaaatgagacctctcggccaccttgtgcaactcaaaatccaatagcaatttggaagttgcccgtggtgcccttgaaagaggggcagacctcgggaacagcaccctgcagaagtgacggccttatctcctccgagagaccgggaactgtttagcacctagagagaagggaatagaatttgctttgctgcatgagatgaccagggtctgcagactttgagccgagctctagcaggaagaattttagaacagggctgggtcctggtggccacagctgttctctctcccagggccagactcttgtttctggctgcagaacggatgtctcattgctcttggggccgggcagggctagctgtgccttgcctccccatcatagcgtcactggtgactgggctgcagctgcatcattgacagtcctggtgacagcagtattaggcattctggtttgctgagcatttactgtgtgctgggagctgctgagtgcctgctgtccgccacccggcctttcctggggtccttgcaggaggacttaggcagtcggaatatgcacagacgtcttcatgtgtgtgggagtgcgtttgtgattccgatgccttcctatttattccacatagtactgggtttctgtatacctatgctgataataagcttctcttgtatgtaaagttatgcctaactgaatgaaagtgacaggcccggggctagacggctgtcgcctgggtaatctctataaaaaagtccctacgcgggggtggcacatgaatgtctgatgtttagggaacactgtgtgtttggaggttcagagagggcaagtgacttgcccaaggccacgcagcttagcgatggtggagcgggacgtgttcccatgttcacgggaattgcgccatacatcctgtctcggggctgggaaagcccacgcaggcaggaccgaggtggtggtagatgtgtcagtcttggctccggaattccttggcttttctgtgtttgaaggatggacagcagccagttgaaggggtggcctcctctgtgactccttctttccctgtgtgagcccgaattcttggtggcatgtgacagaaacccagcttgggctgccaaagacaaaacgtgcagaaggagtgccctggctcccctaatgaagtgagcaggcttcgacctgcctccagccaccatcggacacaacctgctcttaccgccctttcgccctgccttcctgccggtgggcgtgggtctcaggcaggctcctgctgcatggtggcccccagagctccaggctttcattcccagcttagatccccagcagagagcacctttctcctggttccagcagcaaaagtctcaaggcagattctcattgactcctattgggtcacaggctcatccttgagacagtcactggcccagaagcatgcaggactctgattggccaggaccgggtcacatgaccatccctggcacctggggagggagggagggtcaagtctacactaatgagagatgaggtggggcctgggaggcagtcagggcccccaaccttaaccttcctcccaatgcccctccacattaggcctccaagggctttcctgcttggagaaggacggttaccctcttcaggttgggggagggggtgttctgatgaaattgcagggctgggtatgctctgtttcccctcctgacccctgacctcgtgtggtgcagcctcagtcctccgccactggaggcccacatccaggcgctgggtcccggtgccagggtgcatttccctcagctctggggggtgtgtgcaattgtgggggtgctggagagggctttgcatgaggcaggacctgatggacacaccttttctgagggactggttcagggagagtgtggagggggccttggtctgggatgggaccctgttgtaagcccagcaggtggcgtggagctgtggctggcggaggaaggggagaagccttgttgggggtggggggtgcttaggggtttcctggcaaaggcagcttcggagtaggggtccccgtggctcccttgctgggccgtgtcttctctgtggggctgtttttccatctgtaaagctgctagcccgcttcgtgttattcctctggcgtggccacgagtagatcctctcccgtggaaggctccagtatctgccccaggagccgtttggggtacctatccctaggctgcagggcccgactggctgtcattctgcccttggctcttcctggtgtagccctccatgtcctaatcccacctcctagtttgcatctggctaacctcatatcagtcctgtcccatgtcatggtgtcagcctcctgcacagggtcatagccttgcccaggtcatgctgtggcctgtggcccgtggcccgcctgagctggccctggtccctgctgcccgggacagcggtgtgtgatgtccctgctgccggccgcccctcctgggacaggtgctttctgggaattctgccctgtgacttagaaacccgggggccatggagtgaagttggatgggcttaggggggctgggagccatctgggtggtggtgagggcagcgcagagtccctgtgcctgccgggtgaaggcctgggtggggaggaggcctctggtcccttgcgtggcttgcatggctcggagggaccttgaatgccatgcctgtctccttgtgctcccggagaacaggtgagtgtggcagtggatggaggagggtccaggcaggcccctgggtgctcgcgtgtcctcacgggaccacaggaacgactcggggacctgtgcacggaggagccagctgccccgtggctgatcttgtttttcttttcttgttttcccgcaggtgccagtgacggggtggcccgtgagctgatgacgaggactggcttttaatccttggtggtgattaagagaaagcttattggggcctgggagcagctccccgccgacccccaccaccatgtcgggatccacacagcctgtggcacagacgtggagggccactgagccccgctacccgccccacagcctttcctacccagtgcagatcgcccggacgcacacggtaagggggtgcacatgtgtgcgcctggggctacctttgagacccttcttccattccactgagtcttcaccccttcctttctcctgggagccaggctcatgtggctctgagcctcccagggcagaggggaggccgccacagagacccctggtgtctgaagccttttccagaatatctgataaaatctctttgctcccattttaaagctgggaagatggaggctggggccaggctgagctggggctctgccctctctggactggtagtgggattggcacgcgaatgtggagctcctgctgtattcactttcctgcagcctagcctcacctctgctcccccgctgccgcagtattgggtaggattggggtggcttccagggggcaagggggccggataggtcacagctccccttccttcctgtcctcccgttccgtgtgtattcaccttggtgcggctcgaggctctgaggtgaggaggccccacacaggttgcgtttctgcctccctgacatgagggtccagggtgctggctgtgtctttggggagcccgccctgtggccagggcagatggcttgccctgggagcaggtgggcctcgctgcctgcccacatgtgtgccctggtcgggtctcctaagccgcaccccaccccaccccacttcccagcgggggccccatttcctgcctcttctctcactgcatggtgtggccaggacaacgggccttggtttcgctcctttggcatttatggggtgcttgctgtataccatgtctctgggtgtttgccaagcggctttcagagttgtgggcctcccccttgtgacctcctggctgctgagtgaggggatgtgaggcctggaggtcacagctggagtgaagctgaccctgccggccaccgtgggggtgcgtgtgtgcgtgtgtgtgtgtgtctgtcctgcctggctggtgtggtcccctcttgtgagaaccagaaaggaagctgtgtgggaggacgtttccatcagtgagcagaaggttttgcatataagctcactggccctgcctgggggagtccctgacacagtggcctcctgtaggttgggcccctggggcgctttgcagagtcagctgtcctcagtgggtgcgttgtggatccctcttaggacggcagttccctgggcagagtcattgcattctcctgggcggccctgtgaaagagcagctcacgctctcatcccacttcgcagatgaggagactgaggcccaagaggttaaatcacaggcctcaggtgcgattgccctaagtggggaggctgccacagcatcggggctccaagcttctgtgtccccccactcccccgtgcctctatttattgagcacctactgcgtgcctggggctaaggaatagactcccagtgggaaatgattttatattttgtcatcattgtctttatctgtcaccaccaccaacaaaaagaagagctcttgttaactgagcacctactatgggtcaaatgttgttcaaagccctgagtgtatatggttgtgtgcattcccctgatcaccccagagtgggactatcatgctctgtattttgtcaatgggaaaatatttcacagggtaggaaactggacaagttacgtaacctctctgagcctcagttttgtcacccataaagtgggggtactgagagtacctgtctcctagattctcacgaggggtaaaggggatatgccgaatgttcttaagatggcgcctggctcagggccagcccgctctgtccgtttgctgctgccgttccttggtcttgttgctgtacctgcagctgcccagaggggaacctgcctgccctgggggtgctgctggcttctggtttcttgtcctgtcctgtggaggttcccactcttctcaaccgccctcacccggctcctagccttggggagtcctcaggctgctgtggcctctgctctcccacccctcctgccctttgccccaactgggccctcggggtcactggctgaccctagacacctcccattcttctcctgctgggccgtcagtgacgcaggatgtgggtggacagggccaagcgctcaccgccccctccaggcaggaggctgaggccagggagtgagtggggcccagcctggcggccacaggtgagaacatgtctgtccttgtgtgggggcagcaggggccacctgtgtgtgctcctccctgggggagctgccccatatcggaccctcctgcctcatggtagggctgcccatccagagaatcctgcttgtctcttgaagggcaggaggaagagttctgggcactctgaggagggccctgctgccctgggcatattgcagggtggagccgctttcttgctgtgggttggaggtgagctgggggctgtgatctggaggcccctccctggaagcccctcagccctcaaacccttcctgtccttttaaagggcaagacccagttcgaaagatactacccccttcctgagctcctcatcaagccacagaaagacagatccccccgggtaaggggacagtcagtggcgggaacctggctgtcctggttcctcgtacagtagccgaggccattctgctgggatccacgggatgcctcagtgaccttcccagattcaggtcacctccacgcatactcccgacaggcctacctcctgggacagctcctcctgtctggagagtcctcttcctggtgctttgggcacggggctgctttgatggcaggtcttccctggagcctgtgagacctcagtgtggcttcgaaccctctccgtgttcagcttgctgagtggcattggcccgctcacagccacgtggaacggcctcagtttccccacctgcagtaccggtgtcctggtgggtctgtgcatcggtggcaatgtctgcacgcagcaagcgcggggtagtcatctctttcctcctggaagggtggcaggagacccaagcagggcctcttccccctggggaaccacaggaccgtggatgccgagctggcggtggaatggtgcaggccgtggaagccgctgcctctgcctgtgctctgccctggcgtcatctgcgggctgctggtgagtgattcccagcacaaatgggaggcttcacttagttgggtgcttgcagacagaggcctggaccctgagaccatggaaagcccccaggttccctgactcagcctcagccatgctccaggcttctatatgcatcatccctgccctcccgcttcctacctgccgcatccctctgtgcctcattctctccatcctcaggggcccagcttctctccgtgacagtagcaggatcctatgactctccctgagggtcctggggaagcgagggtctccagggttgagggtccagtaacaaaatgctcacagcttttgttttcccggagatcaacgcctcctcctctcctggcctcctttcaggctttctgtggcccagctgcattctgccttcttcttcaagtcctctgggacccctgaacactcctgagctcctccagaccttgggctaaacgaatgggctaaaggaatgcagttaaaagcagggacacagagtctgaatcccagcgtgactcttttctgctgtgtggccttgggcaagttacttaacctctctatgccgcagtattgaagactggttcatagcaccggttctggagccaggttgcttgcatttacatcctgccccagtgatgtcctagctgtgaaacagggggcaagtggccttaccgtcccgtgcctcagtttccctatcagttgagcaaggatagttttaagattgtgaggatccaattagttggtaggtgcagagtccttcgcacagggtatggacagagtaagcagacatttgatataatcaataatgtaatgatgacgatgctattattacaacatcgcctttagtagctttttctgtcttgccccaagggtacactttgggctttgcccctagggcaggggtgagcacaaccttctctgtaaatatttcaggctttgcaggccatgcaaccgcccttcgcggcccgtatggtgtgaaagcagctcagccagggtgtaagggagtgggcgtggcctgtgcctgtgacactggacgctgctgccttggccttgggccctagtgtgctgcctcttggcctagattagctcttatcagactccctatgggaaggaccggtctgtttcatttccagtttgtcacaaatcgatatggggtcccactgcacagacgcaggggctcagccaggcccagtccggcagggtcagacagagttggttgtgcccttggatgccagggtcacgccaaccccagaggtctgcatgctgtcatgttctgtgcccacttcgttgcagttggcaacgttgcagacctttggtggagtagtactgccctgggctaaggctcccagaccctggagactgcctgggccaggctggggcaggtgggcgcgtggggatcactggaagaggctagacttgggaggctttgcagtgtcctgagtgccctggggggggtctctccattagcttcatggcccccttgcagctcagttcctggtgcttggtgatggctcttaagaggctgttgagggatggtttggccctcaaaagagaggctggtgggagctcccatgctggggaagattcattcattcattgggagctcccatgctgggagatccatccatccatccatccatccatccatccatccatccatccatccatccatctggcaaatacttatcaggcgtctcgggcccgtcctcttccaggcccttgcagtgcagctgtgaacagaacaggtaagcatccttgtctcagggagctgacctccttgtggggaatggcgagttgggaaggagatgaggggaagggctgaggttgggggagcccagatttaagtagagagtcggggaggagcctcactgagaagctgcctttggagctgaacctggaggaagggagagggccaggcatgtgggaatctggctgaggaatgttccaggcagcaggaacagtatgtgcaaaggtcctgaggtgggagctctcttgactgtagccgccatcattccgggagagacccgtgaatgcagccagggtctaggaatgtgctgaattcttcctttgctttcccatgaatccagggtccaggaacgggctgaattcttcctttcctttcagtgtgcagtcccaggcattcccttgacaccttctggagtaaggagccctatgcaggggccagagaggggcactcctctcccgcaaaggaacttctcccagtccatgctcaaacatccccccgcatctagcccctttctcctctctgcccccagccactcctccccacccttgggacccagccaagaaggcaccagctgggattccctcctggatgaatggctttttctggtggcctctcacctttcccaggagttttaagggtgtaatttattggtggccctgatttccagcttcagaggtgccatggtcagggagaaccctctgaggccagggggcatcacctgaatggctttttcctgcctccctttctgagcagctgggtcagactccctctgcccaagtcaggtttgctgctgtcctacagggacaggttcagagcctggggactgtcccctcttgtccctcctcagaaagccagctcagcctttgccttgcatctcagaacgtaccccttattgctgtgtgacgtggacaagccacttaccctctctgtgcctctgttttctcgtctttgtgtggggcttcttgtaatacccacctcacagggttgctgtagggatgaaattaactaatatatttagagcgtttagctgcaggtacacaaaggcaatttattactgtggggtattattgttgttttttatgattaatgttgtcgcgttggggagctctcctgcttggagacgtggcgaggtggtttccagcctgggcgtattccagctcatgggaccccttgggctccacctcaggtcagtttctctggtggggcctccccaattcttgccttcccctagagcctccaggtactcttgttgggggagtccctgggctcaaccctggtgacctgcttcaagcctagtggtgggggccagtgtggaccgagtgtctcccagggtttagggtccagtaacaaaatgcccacagattttgggcagaaacggcacccaagatgctcctaggaggatctcctaaattgggaaacgaaggccaaagggttcatgcagaggcctccccagcccccacttcgggcctcctccaccatggttggctgccgtgggcactatcgggccgaggccctcttcccagggactggaccgtccgccctgcttctctgcccacttggccttggtatgggagagctgggtggagaggatcctcctggcagactgtgaggcctgctgctttcttctcacacctctgtgtgtgtggcaaggtctttgcctggcagctgcgtcattgtcagcccagtggcctcctccactccctccctccagccccgtcttctcccttctcctcccactgagagcacctagagtcttgtgctagacactgtgggatgcaggaggaggctcgtgccttttctgccttctggaggctgctctcagccttgggggaatccctcagagaggtgagggagatgagtgtaggaggtgcaggcctcctttaatctgggctgggcacccatttcaaagaggagaaactgaggctcagagggttagaataacagggccaaagacacaccttctgttggaggccttgcagcttttggtatctacatcggactgtccagggaggtcctttccccagcttttccagcttctgaggctgccagggtccccatggattccacttgctcatccttcctggcctctgggctcccgggctcttatgtgctgattttgttgggtctgcaacagatacattatcaacgcacccacctggcattgtctctgattctctttgcaaaaataactgccttgttgaaaaagccagacaacaaaagagtgactagatttttatggaaaattgggaaaattaaaaaaaggtgccaagaagagacgaagtcccttgtaatcccactctctaaagccttacctgtcagacatcactaactgattgccgcaaacagcctcactgagtgttccaggcagacagaactaatctattggaattggtgcgtaagtgaagcctgtcttgtttttgtttgagaggcttgttactgtcttttttttttttttttttttaaacacagtttaatgtttctcaaatctgggtgtacttggcaattggtatacatctaatttgttgatattgagttttaccccctatgataatggataatgtgttaaagaaacaagtatttggactcttgttaagcaggaagaccgtacaggacaattgtgctatcagcgtcaagactgtcacgataagggagagagaccaggctcagcgccaaatacggccaagacagctggggcctcatagcctagccgcagggcggagggaggggtcggtggatggaaaattactaagaggagcgcttgagggtggggggttcctctagactgacttagcaggatgcctgcagctgggcagagccccgcaaggccaaggccaaggccgaggccccgtagagagaggatgggtcagaggagcttgactcaggtgtgggcaaggagagtctttgtcaaatggacgacggtgtgttattaaaggaggaaggtctgcctaaggcttacccttctggctgtgatacgagcggggagttcctcttttacagggcggccttggggtcaggggtcgctttgttctgaaacctggtctttgggcctcgctggctgtcgggtgtttgtcgccatcacttgccaccatccatccttctcctggcgagtgaggcccgagcctcgttccctcgcgtgggcatcacttacccaccctgccaagagctgggcatctaggttgggccttttcccagttgttgctgcaaatgcatttctgtttttacaaataatgctgccccgtatgcaccttcagtcctgtcttcccaggcctgcatttccaagcttcagctcctcaggctggagggacccacagcctggcaggggtaggatggggtgggagggtagaaaagcgaagacagcttcctctactctggccccccagtcaacgccagcatggccggcagacagaggccatggttaggatggttccaggcctgtattagcctgtggcctcagacagccccatcagacctcccaggcttggcggtctcatttggaaggtgggcgtgatcgtgggtccctgggatgctgtgtgggaaggatgcagcccagggccgttcagctgtgttctttctcctccttggtgttcggccccaagggtagcctctggccagacggtccctgaggttccctgcaggacttgggcttatctgcctagggcaggagcgagcctgagcagggagtccacggccttgcccactgtgccctgccgtgccccgccatgcccgtgcccgcccacgctcaccactcctctgtcccctcctgcaggacgtcgggctcctggagtaccagcaccactcccgcgactatgcctcccacctgtcgcccggctccatcatccagccccagcggcggaggccctccctgctgtctgagttccagcccgggaatgaacggtgaggagagagttgctgcctccctgtccagggcgtgagagctccttctcagatggagaagcagaggcccgtggcagagcaggagcacacagggtcctgtgaaatgaggggatgtcgggccgtgtgttcacccttgacctggcgtgggcgtgactcggggtgaggatgggacgagcagggaagagccacgtggccctcagacttccagcgtggaacttcagtggcctctgtgggtttaggcagcagtggggacctccaagctgggctgcagcagggctgggcttctgtgggaagatttgagtccacacctggtgcccctggggcccctgccctctcctcccattcttccttcttctccagctggcagaggacaccctctggtgtgtgcctgtgctgggccagccttactttccttgatccaggtgggaagggaatgaacaggttaggtggtagggtgagagggaggtggggtggggagctggagggactacagcaaggggagggccagggctgggtcagagccagctctccatgcattcacttgggatcggtaggccacgttctttctcccatcttctctaggagcttctgctggagacggctgaggtgtggggaattgtgcctatttctcagatggggcagctgaggctgcgaggttgagggatgggctcttgtttactcagccaggactagaagtcgaggcaccaggccccagcccttcatggtaccacggaggtgtcccagggccccagatcaggcggggctggtgaactcaggtgggcgcaggcgtctggaggaggggaggccgaggcagcgtgccttctgtacctggattggtttcctgggcctgccgtcgcaacgtgccacaaactgggcggcttcaagccacagaagtgcattcctgtgatctgaagtcagggcgtccgcagggccgcgccccctcagaaggctcaaggggaggatgcttttctgtctcctccagcttctgggggctacaggcgttcctcagctgtggctgcatcggtccaatctctgcctctgcctctgcctctgtctcacgtggccatttccttgtctgtctctgtgttctcttgttgtgttacaaggatcccagtgatcctaatccaggatggcctcatcttagcttaattccatctgcaatgaccctaggtccaaagaaggtcttattttgaggttccagtggctgtgcattttgggaggatgttatatttggaggttccagtggccgtggattttgggaggacattatttgagccactgcagtgccactatcatgtttaagagaaaacaccatgcgcttcctgccaagccccatgtaatggtgaagccctgggttctgggccttgaagagggggatgtcttggggcccagctttggagggacaaggacttgagggccctccagggaggtgagcacagaggggtggctgccccgctccccgggggggccagcaacacggccccagcccgtgctgcagtgggcagcattcagtcagtctacaggcactgattgaacacctactgtgcgccagtacctggggacagccatgaacaagacaggtgaaccaccctgcgttcattcatgggtgggggaggtggccaggaaacacctgttgtcaccaagcgcgtgggagggcagtggagagagagcagacaggcgggtgtagtgtggtctggcctgggacaaggaggcgccatctgcaccatgacaggaaggggaggagctcacatggagggcctgaggtctcagtgctccaggcagagcccagcaggtgcaaaggccctggggcaggagtgcagtggcgggacagcgagggccaggccaggcagggcttgtgcaggaggggaacagctgtggattccctgcttagcctctgggaaaagcatttcagcaaggcccatattcaggctctttctggtgggtgatggttggagcctcagaggtggaggccaggagtcccagctccgtggggtgtgcttagttaggcaaggccatgccctctctaggcacactgcggaggagggttcaggagagccagtcgctggggaaactgggcagctccagtctctgcaccaggctgctaggctgagttgagaaggtggttaggccaggttcagcagcaagagttctgcgatcggccagcgatgtctgccctgcgtgggtgagagggaaatggcatcacgggtgctgttatctgtgttaggctcacagcgtttcccggatggactgtgcctgtgaaccacccaatgatcttgttaaaatgccgagtctgactcagtaggcctcagatggtactggagattctgcattgtagccagccccaggtggggacggtggggtggtccgtagcaagggaggggcagtcactctggggtgttccagtgccaccgtagcacactccctccctgtaaatgtcctcggtgaatgtggacctgaaggaaggcagcgctgcattggagtcctgccctgctgtgggaccgtgggaggtgggctcctgtgagcaccttcctggcaggatcatacagagcacggcgcgcagtagatgctcggcgcagagggtggtcggggcctcgggagttctcagagccacaatctcctatgtgacgttggatgcctcacctcctgcaggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggtaagcctgggcccccagctgggagctcctctcccgcttgaggttctgctgctggttgggctgggtgggaggtggtgggtaggggtgcagggagggggcagctcgggcaaaggcttggaggtgggccaagcaccgggtgcacagagctgggtggcaggaagagggcaggcgctgggtctctggaggtgccagagtgtgggaagaagtggggaaggtgttccaggtgggcagagcagcaagtgcaaaggccctggggcaggaataggcttgtggtcacggggtagctggcgtgagggaggggagagctgggatgggagggcctggggtgccgtggagcagagagctgccattcgatgggggtcaggaccgtcctgtggtcggtgggcagctttcagcacattctgagagcttcctcgagggtgggttgtttggttccatgcttgcttggaacagggggctcagtgacccctgcctcgagccctgcacagcaggcagccccctgggccttgaaccccggcccgcgaggtggacagctcagggctctgccaggcacctgaggcttctggattcttaagggtcagggaggggagactccagagtcccgcaaagtgagatgagacagagttggctcagcactaaaggggcggtgcttggttaggacatggcctggacccctagaatgacaaagccgccttctactgcccagtctggctgctccttgggccaccgtgtggcactgggctagcgtgggttgagtctgcagccacccaggcctgagggaccacggatgcactttgggcaggggagccagacaacttcaggctcgtctgcatctccatggggggctgcctggcattgcaggtgggcccaggcctcacctgggcacactcacttatcccagggccctccgtccatctgccctcaggtgacccaggtgcgatttccaccacccccacctccacagctgtgctgcctttgtgcctctctgatccccatttcttcctcactgatctgggaccttgtgggcagggtgtcacctggtcatgtgggtagagggctcggctgtgggccccatgcgtgggaactatttggcacccgtgagccggcatgggtggtggtctggctgcggggccaggccacctgggccagactcggccttctctcggggagagaggatacctgcgtggaacctgggatatccctggggtgggcttgggctggcaggaggtgggggtgccgtcctggggctgggatggctgggcttcccctcctgctctgagtggctgtggccccgacacctgcacacctgccagatacccacagggctgcctctggggccaggggagggaggggctggggtgtctgtgtggtcgttggctggcttggcctccctgccactggggcagtccccgcctcaccaagttgtcacaggaaagtggaggtcagttaatgaactcctagccaacagaccacatgcgcctgagagcccactcaggaacctcccccggcggatgcagctgtgttcttgttggcactcagggactccaccctggccacctccctgctctcctgcgtacttccagtccatcagcaaatcctgacacctctgccctaaaatatctcaattccagccttctgcccacacctgaggcaacccccggcctgagctcgtcattgctctccagtaactttgcagtagcctcctcctgggtctccctgctcctgcctccctctactcccttcagtttatcttccaagcagcagccagagggctcttataaaggcagacgactgcatccccctgtgtgttcccccctgtgctccaaaccatccatggctcctgtctcaagcaggaaaaagccaaaatccttgccatgggctgcaggtccggcgtgatccagccccgtcacctccctgacctcatctccctgcagcagccctctcaaccgctcacgtacagcctcccaggccaccctggagttcctcaaacacgccaggcacattcccacctggggacctttgcaccggctgtgccctccgcaggagcgccctcccccaggcacattcctctttcctcgctccttccagccctggctgccctccagggcctgcatggcaggggagacctgtggctagccctgtggggactctcgaggccactcatggctgaggctgcagccccaccacgtcctcctggggtgtgagattcagccacaggggccctgccggccttgaagggggtctctgtggcctggggcttggccgcctgcacttgggtctgggcttgggactggtgtcgatgccagttcctctcgggcactgcccctcgggtaccccagccagcatccctgccccgacgcccaacccttccagcacatccttcctgcccttcctccccttccttctctccttctacaccttcctccctccttcttcctccctctctttctttccacccaaacagcccccctgtcctgctcactccccttcaccccctgcttcctcagctcctgccaactctccctgctcatcccctggggcaacctccctaccacagagccactcccagccaccacccagcgccacccagcccatctgcctgcggccatctgtccttgccttcattacctgcccctccccctcacctcccagccgcccctcacccatgggttctgcctgccatcatctcccaccagtggccttgcccctcccccatccactcacctcccccattcccttgctcccccaccccctacccccatccgctccccctccttcccccactcgcctggagtccagggtcctgtgagcccagtcagcccttgcaggaactcacaactcacagccggacaagggcgcctgggggtgcttggcccgtggccatttcttggctggagaacgacacctcccacgtgtgtgtccagcctggggcctgccacgcctccagtgccctccacagccctttgatttcactcctctttgaaacagaaagtggaacctagacggtggcggtggtgaggatgtgcacagattaagcacctgtggtttgctgctgtgggagtttgctgtggtttcagtaaagctcaggacataccaggctggaggcttgttctctctccagcttccacagaggatgccgatggcagggctggtgggggaatcgcaggcagtgtccccagaggcttcagtcccccagggtcactcagccacccagctgtgtctgactgcccaggccagggtggggctgtggccaggtggcatcctaatccttgttgtagcctggtgcccggccagctgtgacacgggcccctccctgcacagccctggggcaccctaagctccttagcagcctcagggcaaaggccatcctcctcctgcagcgggagtaggggtgggcggtggggactgggagacagccccggggagggaagtggccactcaggcctacagggtccccttttctgcccagtgcggccggattggattgaatggttgacccctagggtgaggcacctcctttatcaggaggctggcacgcaggaggcattcacgcagtggtaagaatgctgcagtgatggcgggtgccattaagtgagcgccgactgcctgccacgtgccaagtcatgcccagccagtgtcattccctgatctcttcccagcccaaggaggctgggtctgtgacccccttttgtagacggccccaggctgagcgagctggacgtgggggaacgggattcaggcccaggcagctgggagtgcaccccatgcctgcctccaggttgacctgctgctgtgggtctcccctctggtctccctggtggggtgccctcctccctctgcctggcatcccccattagcactggaatctgctttctcctcttttgttttgttttgttgttacagaaggcaggagagaattttagctcagcctcctgggagagatgtttccatttgaacaactcccctgaagtggggcctggatggatagcaggccagggtgtgtgtgtgcatgcgcgcgcgcgtgcgtgtgtgtgcgcgtttgtgtgtgggtgcgggtgtgtgcgtgcgtgtgcgcgcatgtgcgtgtgtatgcgcgcatgtgcctgtgtgtgtccctgcgtgtgtgtgtgtatgcgtgtgtgcacacatctgcctgtgtgcgtgcatgtacctgtgtgtgcgtgcgtgtgtccatgcgtgtttgtgtgtgtgcgtgagtgtgcatgtgttgcacgtgtgtatgtgtgtttgtgtgcgcacgtgtgtgcatgtgtccgtgcatgtgcgtgagtgtgcatgtgtgtatatgcatgtgtgcgtgtgtttgtgtgtgcgtgtgtgtgcatgtgcacgtgtgtgtgcatgtgtttgtgcgcaggcagctcagggcccagccttggagggtgaccaacccctgagtgggcagttgtcccccaggtgcgcgttttgtctctgcgcagagagcaggcccgaggggtgagttgctgcctgcccgcctctccagcacgtccgtgcgctctggcctgtgggttctggagggtctccatcccttaccgttgctctgtgggttctggagggtctccgtcccttaccgttgctctgtggttctttctgcctgcctggctttccctcttcttgtcaggaatgcctctgcctgtggtgcgccctctgggatctctcttagtctctgtgtctgtctctgtctgtgtctctgcctctccatctctttctctttgtgtccctctatctctatctctttctctttgtgtgtgtctgtcaccacgtctctgtctttctgtctctgtttctgtcttcatctatgtccatttctgtttctcgatctgtctgtctgtcttcgtctctgtgtctgtctctctctcctctctgcttggaccacaaggtggaggtgtgatgagcttggtgctggggcctgaccagcctggccgcagtaattgctccaggccgtgaagagatttggaaagtctgagcaagggaagatgcctgggagagcgagttgagaggttttctgcatctgctgtgtggaattcagctgggcgcctgaggcaggaatttgatgggatttttctgtgtgtgccccctctgccccaccgtgttcctgttttctgatgcttctctgctcttcagcctccggagttttgtggcatcagagacttccttgggaattcaccgaactttgttttggggactttagaattgtcacaaatagcactatctctgaaaatccctaagggggacagacagcccctatcaaatataaacatgaattctggctcacataactgaagtccagcattggttagcttcaggtaacagcttgatctaggtgacacgatgtcctcaggaccctgtcccttttcatcccttggctctgccatctttcacagggtcttggtgtgttagcaggaaggaagccggtgactccaggccttcctccaggttcaaggccagcaaaaagagagaactcttcctcctcctctccgcatttctagccccaaactgcttttcctcctcaccatgagtgggcccatgcctgtcctagaacctgtcattgtggccggagtagggggtgtattgggagtgcgtgaagctgggccctgctttttcctggagctggcacaggggagcccaggggcttttctgcctctctgtcttcagttttgcataataaacttttctctttcacgctagcttgaagtttacaccaggggcatctgatgagtaagaggtacccactgccccctggcaacttgtgcggggtgtattagtttgttgttttgttccctgcagctttgggtgagtgggaaggtggacagtcatcaggagtgcacctgcaggcctgaccgccaggctccctcagcccccgtcctgggaaacccagcaccaggggaagcgctcttggcaatccgggtttgcctcttctttttcagttgagggtcggttcacaaaaaagtaaccacattaaagtgaagagctcgttggcttgtaggacatttacaatgttgtgcagctgtcacctgtctagttctagatcattctcatcaccccaaaaggagacccccatactcattaatcagtcactccctgtgttagtctgttcttacaccgctaataaagacatacccgagacagggtaatttataatagaaaaaggtttagttgactcacagttctgcatggctggagaggcctcaggaaactcacagtcgtggtggaaggggaagcaaacacgtccttcttcacatggcagcagcaagaagtgctgagcaaaagtggggaaagccccttataaaccatcagatctcatgagaactcactcaccatcatgagaacaggacgggggaaaccgccaccatgattcaatgacctccacttggcccctcccatgacatgtgggaattatgggaactacaattcaagatgagatttgggtggggacacggccaaaccatgtcaccccccacttccccctcctcctttttcctggcaaccacgaatcactgtccatctctctggatttgcctattctggacatttcttgtaagtggaattgtacactctgcagccttttatgtctgtccacttccactcagcatcatattctcggggttcatccacagtgtagcctgggtcagtgcttcattccttttttttttttttttttaataaagatggggtcttgctatgttgcccaggcggtcttgaactcctgggctcaagcaatcctcctgcctcggcctccatgtccagcccttcacattgcttgtatggatatgccatgttttatttatctgttcatcaggtgatggacttacttgtgcaattttgctgcgaataaaagctaaacccgaacttaaagaagaacccattaaagacaacggcttttatccatggagagtttaaaggaagtaagttttcagcaacttttccaagtgttgctagtggttgccagccgctgcttttactcctggtgctgcctgttagccctggggatggaaatcttctttttgttaatgttgctttggagaattattcccaggttggacgagcagtttgctctcagagttttagggtggcctggcccccatagcccttccttccacatccttgtccttgctctgttatctctcttcttggtccaggtggaagagcagagataggatagcggagatgtttcttgccaccagtagtgcgaccgggctctgggtgccatgtttgctgccaccttttgtcttaagaacctcaagaaatgacatgggctgtagggagagaccagccaagcacccaaggtggaccgcagtgagggcctgggcggtggcgtggggatgtctcacgtcagttggcacagaaggggtgttgggcactctgggtagcggagccagcctgtgcaaaggcccgggggtgccagacgcatgagctgtccatggtttgctgtgggtggggtcagatgcccatggccccctgcctgccttcctgttggggagcagtgagggccccacacccactggtacgtgcatacacactcctgaggctttttctagggagtttttcttccacacacacttttgccttgagtttctggaggtcctgcactctgggtccctggaaggggtgctgctttggcgcttatgctcagccctatggttctgtggggtgaacggatgtgtggctgggaccccacgtggagtccccacatggctcagccccacggttctgtggggtgaacagatgtgtggccatttctgacgtgggagcccctgcagcctcccccttcaagcaccttccaaggtaggatgctgagtggccttgggcatgtcgtcaaacagaaatcccacttcccacggtggttatgacggttacgtggattaagatttgtgaattgcttagagcaggaggccagcaaactccagcaagctccaaatctggccctcagtgtgtttttgtaaataaagttttattggcacacagccatgcccatttgttccccgttgcctgtggctgcttttgcaatacaatggcaggggtgagtagatgagacagagaccttgtggccctcaaagcttgagctatttttaccatctggccctttataggaaagtgccggcctctggcatccagccccagtggcctccaggctctgtttctgcctctgcgtaatggagatggagcagcagtcccctcggagggctgttgtgggatccacttcatggggtgtgcagaggacttcatggggtgtgcagaggactgggataggctgagctgtgagcagccccaggtgtgatttctaggtgtccctgggggaggtggcctgaggagcatggaggactgcattggggcgattgagggatatgagcccttttctctgtttccctcgaggagtccgtgtgtgtggagggagcaccgggttgtccaggcccctgctgtccttgcccccacatctcacatggtaacagaggccagaggcaaacctaatgtgactccaagactcttggcccctgtgggtcttgctggggctctgtggggtgaggggaggacagaggccctgaggatggcaggagtggacagaagatgatgcagcctctgtgaatcctgaggttggtggggcactcggtggcccccgggctgcagttgtccggagaataatgcaccctgtgtcctctgggtgcagctgctgcgggggcggggaggtggtggcctggcgctgctctgggccttgtctgccagcagctgccggcttggccccaaggatggcacagggcgggggctgggttctggagcccagctaggggaggaccatcccagccaacatttattgaggcttacggtatgccaggctcagagccattaactcattcaagactcacaaggaccggggaggtgccagctgttctccccattgggcagatgaggaactgaggcaggaagcagttgaatgacctgctggaggtcacggaactggagagtggcagagggggctgggatttgaacccagggctgcacaggtgaggcctgggttgttttttctaacctccttatcctgagagtgtttccagcacagcctgggtgcaccagactttagctggtgggatgaaggcgtccatggataactgaatgcaggcttcctttgttgttaagcacattttcaaaaacagctgtattacacaaagagtgactctcagtgaaagaagatcagaaaaaataacgggcaaataaaaagaagaaagtaaaaataccctcttctgccctgctgccgagataactccttttagcttaactgtagcccgttctgatggcttttccgtgtgtttgggaacatatgttttctgcaaagccacgtgtgtgttggctgcatggttctggaacttgcgtgtttggactgagcttcatggatgaatgtttacagagggtatgcagaggccaggccttgggagaatggaggctgtgggtcttggttccttgggctggtggggaacacacagatggggtaagtggaagaagagaggtgtgttacgcgaacagggagttggaagacttcacaacttgaggagaggctgggaaaccattcatgtagcaagagcatttgaaccgcatcttgaaggctgtaagggactctgaattttggagaatgggtgatggctgggatgggaatgggatccttgaacaggtgaggactgtcctgacagatgtccaggactctgggcctggagtcagggatggaaacccggggtgtattggggagggggtgtgtattagtccgttttcatgctgctgataaagacatacccaagactggtcaatttaaaaaagaaagaggtttaattgtactcacagttccatgtggctgtggagggctcacaatcatggcggagggcaaagaggagcaagtcacatcttacatggatggcagcaggcaaaaagttggcaactacattagtcagggttctctagagggacagaactaatagaaaaaatatatatatatattacataaaggggagtttattaaggagtattaactcacacgatcacaaggtcccacaacaggccatctgcaggctgagaagcaaggaagccagtctgagtcccaaagcttgaagaacttggagtgtgatgttcgagggcaggaagcatccagcacgggagaaagatgtaggctgggaggctaggccagtctcgcctttgcacatttttctgtctgctttatattcgctggcagctgattagatggtgcctacacagattaagggtgggtctgccttctccagcccactgactcaaatgttaatctcctttggcaacaccctcacagacataccgaggatcaatactttgcctccttcaatccaatcaggttgacagtattaaccatcacagggttgtacagactggggggtgtcccctgtgctgaccccatgcccgttttttttctgccacaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcaggtgtgaatgggcagggggagggggagtgtttgttctgagtctccattctagcagcagtgacagcggtgtcacagacatgtgccaagcccttcccaagttcctgggtgctcactggtttttatgccctttacgtttattggacaggagcacatccacagaactttctgccatgatggaaacactgtgtatctgcaggatagccatgttccactgttgagcatttgaaatgtgcctactgcgactgaggaactgatttttaatttttatttaatatacgtattaaatgtgcctttgaatagccacacaggctgccgcattagacagcacaagaatggagggtgaaaattcaggatttctagccagtctgtccaggttcagatcctgtttcttccagtaccaggcaacgtggggtgggcagtcccttctctgtgcttcactttccttatctgtaatgtggggaaacagcccctggctctggaatctgaatggactggcctcctaactgctctttactagctgtgtggccctggaaccttcatctcttggagccttggtttccttgcctgtaaaatggacaacttgtagaggagggagcaagatcccgagattaaaaataaatcctcattgtcactgttgaaaccacacaaagacaagcggagaaaaagctgatataaatatttataacattcattttataactttgttttaaatatgagttaatatacaattctttgataatctgccttttcccagctcttcatggtttgctccctggtatcattcaggtctctgctcagatgtccctgacaccaagaggccactgtcagccttgtacaggaacacacacccccaaccctcctctatcccgggttcagccaatccagccaattctagctgctgctggtttttgtaaataaagttttattggcacagccacgaccacttatttgtgtatctgtatacacatgtgtgtttatatgactgcttttctgccacagtggcagagttaagtcatcacaacagagacctgtgtggcctgcaaagtcaaaaatatttgctgtttaggcctttaaagaaaagctttgggctgggcatggtggctgatgcctgtaatcccagcactttgggaggctgaggctggaggatcacttgagcccgggagtttgagaccagcgtgggcaacatagcgagaccctgtctctacaaataatttaaaacattagccaggtgtggaggcacatgcctgtggtcacagctactcaggaggctgaggcaggagtgcctgagcccaggaggtttaggctgcatgagccatgattgccactgcactcttgcctgggcaacagagtgagactctatctcaacaaaaagaaattttgctgatcactgatctgtctcatcaccctgctggtgacatcattatttgaattaatatagacccagctttgttatacagtggtcctctccttgtctccctgttaactgctgtgttctgagcagcatggggtacatagtaggtgctcattaaaaatggttgattgagtcattgtgacactgtctgggccccagggagcgtctagactaatgggagaaacaggctcatatctagtgccctccagacaaggaagtaggggctccaaggaggatcaagggctcattttagccactgtaggcaggtgggtgaaggctggtgagagtaggcttccaggaagaggtgccctggtagctgggttttgaaggacgctccagggggagagcattgatttcaagtgtccatcgtggctgtcacgtggttgggggaaccaggatttgaggatagtccagcagtgagacccggtcctggagactctgccaactgtcctaggcttcagtgggcagtgggtaggtctcatgttggtggcacaggcatcccgagaggggccgggccccagcggcgtgggcaggcattgccagggccagcctggtaccgcaccgttaggcttccaggcctggccttggggtggggctgaagctgcgggtcactggcacacattggtgactgcagctggaagccaggtggctcaaggcagccctcaatggttaggtttttgtttgtttgttttttcccctctaaattccactttggcattttttaaaagtgaaattctcaagcataattattttaaagtgcacaattcagtggcatttcgtacatttgcagtgttgtgcagctgtcacctctctctggttcccagccatttcaacaacccacagggaagcctcataggagctaaagcagccactccccgttcccctactctctgtctctatggactgacctgttctagacatttcctatatagggcatcacacagtatgcgtcctttctggcttcttccacatagtgtcatggttttggagtttatcatgttgtctcttgtctccatccttcattcctttttatggctgaaacatattccgttgtatggagatgcctccttttgtttatttcatcatctgtggccatttgggctgtggctgttgtgaatagtgctgctgttgaacatttgtgttgaagtttttgttgggacacctgttttcagttctcatgggtatatacctaggagcagaattgctgggtcgtgtcgtacagtaactctaggtttaatttgctgatgactttccaggctgttttccacatcagctgccccattttacattcttaccagcaatgcatgaagattcctggtttcctggttttccacatcctcaccgaccgccccccagctttttttttttttttttctgagatggattctcactctgttgcccaggctggagtgcagtggtgccatcttggctcactggagcctctacctcctgggctcaagcgatccttctacctcagccttctgagtagctgggagtacaggtgtgcatcaccacaccgagctaatttttgtgttttttgtagagatggggtttcaccatgttgcccaagctggtctcaaactgctggtcttgagtgatctgcccaccttggcctctcaaagtgctgggatttcaggtgtgagccactgtccctagccacaccaacccttttttatcttcctttaaaaaatgtttttgattccagccatcctagtggttgtacagcggtatctcattgtggttttgatttgcattagagagccctttatagcgtgtcactgctgtgcagcagttttttcagcattatctccttgatcttccaaacaaccttatgaggtaggcatatacccacaggttctgctgaagtagacactgaggtcagggaggtgaagggccctggctgaggctgcagagctggtgagcggggggctcaggcttgaatccaggcccagcagagctagtcaccctcttagctgggtctctgtaggtgtcccaggtagtattttctctagtacctgaggaagggccaccttccctggctggagggagcctccctcctgcccaccctttcggggctgtgggcttcttccccttcttggctttgtttgttccgtgctttgggggagcattttgatgcccttcttgaagcgaccaccaggggtcgctgtgggactgaggcagttctgctcaaaccgccagcgatggagtctgtaaaagccagcatcctggattttctggcttttcctgtgttcacttcttcttgggcacctttctgggttcatactgatctgctctgtggtaatgtgcaggctgtgcgagcgtcataagtggagcagaaccatgttctgatctcacttgtgatgccctgtcacattgcagaatggggcattggccttccatctgaccttgggccagtgccctaaaccctctggtcttcagcctccctcttgctatgaagcagacggcagcatgatgggatgctctttccaacggtgttaggaggagggggttcatacatggacagatgaggatgaggatgatgggggtgatgaggatgagggtgatgggggtgatgaggatgagggtgatgggggtgatgaggatgatgggggtgatgaggatgaggatgatggggtgatgaggatgaggatgatgggggtgatgagtatgaggatgatggggtgatgaggatgaggatgatggggtgatgaggatgaggatgatgggggtgatgaggatgaggatgatgagggtgatgaggatgatgagggtgatgggcgtgatgaggatgagggtgatgaggatgatgggggtgatgaggatgaggatgagggggctgatgaggatgaggggggtgatgaggatgaggggggtgataaggatgagggtgatgaggatgagggtgaagagggtgatgaggatgagggtgaagagggtgatgaggatgagggtgatgggggtgatgaggatgaggatgatgggggtgatgaggatgagggtgatggggtgatgaggatgaggatgatgggggtgatgaggatgagggtgatggggtgatgaggatgaggatgatgggggtgatgaggatgaggatgatggggtgatgaggatgaggatgatgggggtgatgaggatgaggatgatgggggtgatgaggatgagggtgatgggggtgatgagaatgaggatgatggggtgatgaggatgaggatgatgggggtgatgaggatgagggtgatgaggatgagggtgatgggggtgatgaggatgaggataatgggggtgatggggatgaagatgaggggggtgatgaggatgacagtgatgaggatgaggacgagcagggtgatgaggatgcaggtgatggggtgatgaggaagaggatgatgggggtgatgaggatgagggtgatgggggtcatgaggatgacgaggatgatgagggtgatgaggatgaagatgatgggggtgatgaggatgaggatcatgggggtagtgaggatgaggatgatgggggtagtgaggatgaggatgatgggggtgatgaggatgaggatgatgggggtgatgaggatgaggatgatggggttgatgaggagcacttgtgtgtcaggtgctgcgtgctttgcatgcatcatgagctcatttcaccttcacaacggctctctagagtagtaactcttttatccccattttccagaagaggaaggtaaggcttagagaggtccaggagcttctcaaggctacgcagtaagtaggagtgggagttgggctccagtctcaccagtgcagctgtggagtctgcacagcctctcctagcactgatgctgcctgtaggaaccgtaatgggtaataatgccggctcggagcaggcctgactgtgcctgcctgtgtaactcattcagttctcaccacagtcagaatggcggcacggcaatcagccccgtttactgatggggcaactgagggctagcagggtgaggctgcttggctgtgcttccctggctggcaagtcacgaaggcaggatttgaacctggctttggagcttggaggctgcagctggccctggagctggggcctctcccgggtgcggagtccctggggtgactcacaggaaatgtgtagcagcctgacttcctgtgcgcggccgtggcccgggctgcaagggggcctccccgcgccctgggggctgcagccctccttccgcccgctggggtgctcatccctcacgttctgcctctccccacagcaacagctggaggaggaggctgccaagccgcccgagcctgagaagcccgtgtcaccgccgcccatcgagtcgaagcaccgcagcctggtgcagatcatctacgacgagaaccgggtatgtgtccccgccctggcctgctgccccccggtgctggccatgaggcgcttcacagggggcaccatgaatcaggcctcagtgtttccatctatgtggggaggggacctcgccaccctctcccccagagacgcagggtttatgagtgggtgggggaaggtgaccggtggaaagccatcctggtgtggcctctgggctgttctgctcagacactcagatgggtgtggactgtggctggtcagcaggatgcaacacaaaacagaggttttgggctccaggagagcaccagggtccagctcatggccaagggtaaggggctgccactttaggtgctggtgcagaagaaatccctttaaggcaaaagataatgacattatgaccgcagcagtgaggtttcatggagcagcccctcctgtcagtcctggaagggcaggtacaggtgtcatttccattttcctaaggcccagagaggttaagtgacttgtccagagtcacacagctaggaagcattggacctggatttgaacctgtgggctgtcagaccacagggcctgagttctcagcactggcttccactgacactgggccctggaaggggcctttgagatgattgaaacacagagtctggagcaggctgtggaggcccatggagatcccactgggggcagctatagtgggtctggtcttgctggaggggcttgggatgctcagagcagtgtctccaggggctggaccctaagggtctgtgcacccccaaggtggaaccttgtgtctggtgaggtggtaagctccccatcttcccagtcaagccactaccagctgggctttaatgatttacagtgtactttttctaaatgtactcaggatctgtggatgttgatcccctcccttattttctggatgaggaaactgaggcccagagagggactggtccttgtgaagcatgacagatgaggaacctcctctccctgccttggcttctctggttcccctcctgcctgtagtcccagccacccttcccagctgccttttctgtaatatcttccttggccaatcagtgctcagagttgaggtgggggtggggaggcctcgagtcacgtggtgggtgcctgcagtggcagcctgaggcagggaactactggatcaacctgtttggctatgcctccacctctagaaacagcgatgtcatgcagaatgagacaagcctgtttggggcctgggaactgtgtgcccggctcactctcccacaccctgacccctcaccccaagcaccactagtaacagtcataggagagccaaggggccacacatccttcagccagccatcctgggttcaaatcccatttctcccacttcctggctctgtgaccctggagcgttgtacttaaaccttcctgtgcctcatgctccacagctttaaaacaatgacaacgacggcatcacctagtacagttggtgtggggactaaaggggtaatttcctagtgcccttaggacagacagtgtctggcaccaaagaagtgccagctggtgctattaattgtcattatcatagctctcatttcttcttgtgtttgtttaccttgtgcatttaatagaatactatttgcatttagtagaactactgttattctctcaattttgctcatcaagaaaccaaagctcagagagggaaggagacctccctgagattgcagagcaagtgagctttgagcctgggacttggagccaagattgagatggctccaggagcccaaagtggaggggacatgggcagggctcctgagagtgtcacctctacctgccctctctgatcctcggtggagagcagacacggttctctccagcagctgtggaggccaggtcagtggcccagcacattgctgcagtgccttggccctctgcctggagctcctctccttgcaaggctcatactgtcacttccctctttgctgaagtggccccttctcagcaagacccgtttcaaccctctacttaatactgaaaacccttttttcaggaaaaggagttttcaggatgacacccgttttcctcctttgtggcttctgattctccttagcccttgtccccatgggacatgatttctgttttacttatttattctgtttattatgaatggaaactccgtaagggcagggattttattcctgcccacttttatttccagtggcatctccagcacctaaaacagtgctcaccacacggcagatgcacattaaataattattgtgcaaatattcaggcggcaggaagggaggggagatggaggcgggtggccagctctggcctgtggaagaggcctctggtttgggggcgtgggggctggtggggatcctcccgcccgggctgagtctctgagcctccaaagcctgcagcctaatgtgcgggaggcccccagccgcctttggcaggagcagccaggacttaccgccccttgggggatcagtaggattaaattttaatctgccttccttccctgctggttcctggagagatggaggacaagggtctgtttttcgagccagccggaaaacgcagcttccctgccgggcagggcccgcctggcagttctgagtgctggagtctggctcattatccattcggagcacattggtgaggcacccgctgagcgaggcttttcccgcctccccgcctcctgggagctgcctgcgtgggtgggggccgggcaggtgtgcacagatggcagggcagccatcagggtggctgcagcctgagagcaggagcagacggggtggcctgggcccaggagggcagaagcgtgacctggaagtgggtgctgggaaaggcttcttggaggcagcgggtgggccggaaggagggcgttagggtgagggggcatggcacaggccaagtcccagagaggggactggcgtctcctttgatcttcaaaggtggtgggcacgaggtaggagcctgttggttccgggacaaggcacgcacttggaatctggataaaacatacacagaggcagcgctagcgatgtgtggatacataaggggcatttgtgcagcacaggttgctggtaccgtaggaattcaggacactggggaacagtcaggatgggcttcatagaggagacgggccttgagctaggtcgactggggaaaggtagaaggctgcttccaatagagatgtagatggctcattcacaaggtggagaggaggcaggattgatggaagcggcaaccccagttgctgagtaatgcggaaatcagcagaagactcaggtccttgtcttccagtttaagcgtcttaaaaggaaagtgtttatatgatgtgattaggactcagtgtgtgcacagtgtgatcgggactgagcagggcaaagaagaataataccattaacagtcaccgtgaacgtgaagcattcagtagagccttttgggggttttggcactcctcatgcttgtttgtagggcccagcatcagatcccctgattgaagattttcagagcagtgcttcagaccccgtcctgtggcctcagcatcctgggccaggcccccacctctggcctccatgcccggccacctggtcatcaaaactgcccccagggtccaggggttctttcagattgtccgtttcagccccgcgaggctgctgcacgcgtcctctgacctgccgcttttcctgctcgtcacccaccctgggagagctctgcacggggctcatgggcatggggctctgtttgcagatgaggaagctgaagctccgggtaggccgttgccctgaggcactgctgcagccagcggaggggcttgggtgcaggactgggggctcggggcttcttgggtgagtaggtgctgcccccaatctgcagatgaggaagccagtgtggcagagaaggggctaggatggggcttccaggcaggggagaggctagggagtgatgagtgtcaggtctgtttctgtgctctagaggagagccgcatgtggatgtatgtgtggtttgtgtgcctgtgggtacacgtgtgtatacgggtggatgtatgtgtggtatgtgtgttagatacacgtgtgcctttggatggctgtgcatacttgtatgtgaatacttagagtaagagtcagcttgtgtgggacgagcatgtggtgattcgtgcattgatacagcacacttgggtgtgtgtatgcgggcatgtgtgtatgtgtggacctctggatggctgtgtgcacatgtgtataagcgtatatgagtcagcatgtggggcctgtggttatctgtgcacttacacatccatgcatacacacgtgggtgcgtgtatgtgtgcaggtatacctgtgggtgctgtgtgcacatgcgtgaacattcatccacgaattggcacatgtgaggcatgtatataggtattcgtgcatctgtgcacctgtgtgcatacgcatgtgttcacatgggtacacgttaggctgtgtgcatgtgtgtacaggtggatgtgcgtgagatggcgggtgtggggcgggtgtggttacatcatgtgttcacttgggtgcacatgtgtatgtgcgtgcgccttgatgtgtgtggacatgtgtgtatgtctttgcgtgttcctagatcttggcatgtgcacttggtaacgtgggtctggtgctcccgtggacccgtctgcataggtgactaaggacttgtgtgccccagcacagctcctaggctttttgggcatgggaggcctggccacgcagacccagagtctctgcaggggtgccactgctcgaatgagaacgtgcccggatctcagttggctggcgagagcccctacagggggtggacgccacggtgagcggggccgctcattggcttgagtccctaggttttcctttcctctcagagccaggtgagcttgggcagtggcttctctcaggcttggccacctcccctgcggcgtcagccccacccaccacgatcagagcagagacctcggcccccaaaggccaggaacgtgggaggacgtgcgtgggggcagtcgggtttcagcgggattgagaaaggcctgtttcccttctcccccaggttggggctgagtcccctgaattccagcctcccagccggaaggtggcagcccagcctgaagccctcctttgggccggagcagtccctgagttttgccacccttgggtggagttagttcagctctaacaagtgtgtcctggcgtcccctgcaagctgggccttgggcccgcatggggaagatgcagacaggagctcctgttggagcacttgctgtttgccaggaccaggggcagccagggagacagtgtcgggaggtggcccccaaagggccgaggagatgtggagatatcagccacgggaatattggggttggggaatgttctagatgggagaggttcaggtgggaagggtttgggattttgcctagaactgtgtggattggtgacctcctatccaagtgtcctctccgagcctcagtttccccatctgtaaaatggggcagcccctgcaccccagaaacaggttactgggaggcttggcaatcctgattgtggcttggagagcagggagacagggcctgccctctcatccacctctatggagggggcagagaggactccgtgtccttggaaaggccaggcacatccgggatgtggactgcttcccccatggccctggagaaagtgcccactgccctcaaccctgtgctgggccctgctggacgatagcagcttggtggccagcgctggcctcttctggtcctggtggagaggcagggaggccctgggccagctgcagcgacgtggagagaggacagggttctgggctgggaccggacagcctgcaggtacaagaatgctttgccccagagaccgcctgagcgagggagccagccgcactccatttccaggtatttagaccattcctgagcatccactgtgagccagacactgtccaggcactgtgggtgcagcagagaacagagcaggcaccttgctcctcatggagtcctcatcaggggaggtggccagtaagataaacagtgggacgcagacccttatccctgaccgcatgtgctgtgaagacagccaggtgggaaaacgagtggtcgagggaggtggaccgccctgctgcggggggtcagggaaggcctctgtggggaggggaggctgagtcaagacatgagcaagaggcaggcgagagcatgtgaagatgtggggaacagcattccaggcagggaacggtaggtgcaaaggctcagaggcagtagtggctttcagtgtgcaggggacagtgaggggccagcagaggtcaaggtcctgtgagggctgggaccctgttgaccctggcgaggagtttggatttggtgctcagggtggcaggaagacagcagccgaggaggtgagggggaatttttggcatgaggctgaatctgtggcctgcgtccacgttccccagccatgccacgttctagagggtatctcctctgcattcaaagagggaagggatgacatgcacttcactttgctccctgcagaacgtccttgcagaggtcatgggagtttggtaccctgggtgagtgtggccgtttcgtgaatggggagactgaggccagactcagtcaggagactcagattgctgagggttagagcacagccgactcccagatgttgggcaggtgtgttgagaaaggccagcccatcttgggacagggctccacaggcccacctccccaggaggctgacaagcaggaccagagaagaccgtggagcaggaacaaacccaacactgggagcaggggatgtgggggcaggaggtgaaggaaacaccccagagagacaggaggaggtggggctccctgtggctttggcaggtgaagaaggggtcttccttgctctctaggtgctagctgtgtggccgtgtagtttctagtggcttggccctttccgttggtatcactcttttatctagatggacagttgctgctgatccccacagatcatacacaaactcctattcatccctcaaaacccagcctatatagccctcctgttacctttttgggagagtgacttgtgccccactttcacacatacctttatctgcctgagcatactaatctgctgttactgctcttaaccaacagccattgtttgggtttattccaggcaggggccaggtctcattcattccatgtctctccccaggtcccagtgtttgggagctgccctgcccccatgctaccccatacccagtccttcactgggcctggcttaggggttctcccatcttcagtaccccagggcagactctttcctgcttcgagggtgtggctgggacattgactctccgggtgatgtctgcccccatccaccggaaatactagtcccaagcctaggggtggtcctgcatgggacctggcccttggcttcctctgtccgtggatcctggaggtcataagaagggcttcttccctgtgttttgtttctgtgcctcagtttcaccatctgtgagatggggctactcctgcctgtacctcccatggcgcttatgcgcaattgacatgttaagaacacaccgtatgcccgacgcttggctcatggcaggtgcttggagaagtgaccatcgctgtaatagttctcccctgctcttctggcccccagccgcaccttgaggctgcaggtctcggggttttggctcagcctgaaggtggccaagagcatggctctgctcttggtgggccgggctctgggctgtaggcggaggcagctctaggttccagcttgagcccacctacatacctgctgtctttctccgggggctggggagggggagtgatgctgggctgccacgccctcctctctctgctgcagcccgggagcctgggcacctccgccctgcgaggagatcttggcaaaggctgcgtcaaatttttgttggcagccacatttcccagggcttggggtcacctccttttggccaatctggtttggggtcactggggacagtttcagtatggtgatggtgacttctgcggcctgtccgcctagtccttgccaaatactgagtggctgccccaatgcagctgagtcacagcaggggctcgcccgcgtgccagcctgtgaacacccatttgccagcacacacgcagtttagcctggtgcagggggcacccaaacccacgcaaattctgcccctgccctccgccacagcccccatgaagccaccttcaggagcccctccgccccccacctccctgtacccggctggcctgggctgccctccaggcctcctgtgagtggaccctggtggtcccaggctgcgggctggtgggcctggccgaggcacaatgtctgccttcacaccgagggccggggtgggggcccggaggtccagcctattgatggagcggccaccgagccctgcgccacatgttcctgttttcctaataagtccccagttgtgagtggggaggaggcggggaggccccggggcagcccagaaataatcacatgattgtgaaacacaagaatcctagaaagggtatctccgagcgcctctatctcaccctgcctcctcctcctcctcctccttccctcgctggctgcactagctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatatgagtcagcatgtggggcctgtggttatctgtgcacttacacatccatgcatacacacgtgggtgcgtgtatgtgtgcaggtatacctgtgggtgctgtgtgcacatgcgtgaacattcatccacgaattggcacatgtgaggcatgtatataggtattcgtgcatctgtgcacctgtgtgcatacgcatgtgttcacatgggtacacgttaggctgtgtgcatgtgtgtacaggtggatgtgcgtgagatggcgggtgtggggcgggtgtggttacatcatgtgttcacttgggtgcacatgtgtatgtgcgtgcgccttgatgtgtgtggacatgtgtgtatgtctttgcgtgttcctagatcttggcatgtgcacttggtaacgtgggtctggtgctcccgtggacccgtctgcataggtgactaaggacttgtgtgccccagcacagctcctaggctttttgggcatgggaggcctggccacgcagacccagagtctctgcaggggtgccactgctcgaatgagaacgtgcccggatctcagttggctggcgagagcccctacagggggtggacgccacggtgagcggggccgctcattggcttgagtccctaggttttcctttcctctcagagccaggtgagcttgggcagtggcttctctcaggcttggccacctcccctgcggcgtcagccccacccaccacgatcagagcagagacctcggcccccaaaggccaggaacgtgggaggacgtgcgtgggggcagtcgggtttcagcgggattgagaaaggcctgtttcccttctcccccaggttggggctgagtcccctgaattccagcctcccagccggaaggtggcagcccagcctgaagccctcctttgggccggagcagtccctgagttttgccacccttgggtggagttagttcagctctaacaagtgtgtcctggcgtcccctgcaagctgggccttgggcccgcatggggaagatgcagacaggagctcctgttggagcacttgctgtttgccaggaccaggggcagccagggagacagtgtcgggaggtggcccccaaaggggccgaggagatgtggagatatcagccacgggaatattggggttggggaatgttctagatgggagaggttcaggtgggaagggtttgggattttgcctagaactgtgtggattggtgacctcctatccaagtgtcctctccgagcctcagtttccccatctgtaaaatggggcagcccctgcaccccagaaacaggttactgggaggcttggcaatcctgattgtggcttggagagcagggagacagggcctgccctctcatccacctctatggagggggcagagaggactccgtgtccttggaaaggccaggcacatccgggatgtggactgcttcccccatggccctggagaaagtgcccactgccctcaaccctgtgctgggccctgctggacgatagggcgacggctggggtcgcggccggcgcgcggctcgcggctggggggtaggggctggccccggggagggggtgtgggacctcgcggtgccttggggttttagggcggtttgggctggttgaggctgggtgtgtgaccacgtcgtttttcttggtcgactccgtcgctgagcgcgcgttgagggttgtggggttgcccggcggtgctgccggttcgcggggggtgtgtgcgctggggcgttgggtatgctacgtgccgcggcacgaccactatctcccgttttatcgcgggtgtggcctgtggtttatttggcggtatgcgggtgtgggggggttcgtccccccctcgcgtgttgggtgtgcgcgtgtggcttcctgacggtgcagtaggggtctgcgggtctgcgcctgggcaggtggtctctctcccagcccgccctcgcccctcctcaccccagcccgctctccgcacgccccacgtcccccccagcatttcagtcagtctccggttcgctctaagtttcacagtcagtagtggctttcagtgtgcagtgttcagtcaggggccagcacaggtcaaggtcctgtgagggctgggaccctgttgaccctggcgaggagtttggatttggtgctcagggtggcaggaagacagcagccgaggaggtgagggggaatttttggcatgaggctgaatctgtggcctgcgtccacgttccccagccatgccacgttctagagggtatctcctctgcattcaaagagggaagggatgacatgcacttcactttgctccctgcagaacgtccttgcagaggtcatgggagtttggtaccctgggtgagtgtggccgtttcgtgaatggggagactgaggccagactcagtcaggagactcagattgctgagggttagagcacagccgactcccagatgttgggcaggtgtgttgagaaaggccagcccatcttgggacagggctccacaggcccacctccccaggaggctgacaagcaggaccagagaagaccgtggagcaggaacaaacccaacactgggagcaggggatgtgggggcaggaggtgaaggaaacaccccagagagacaggaggaggtggggctccctgtggctttggcaggtgaagaaggggtcttccttgctctctaggtgctagctgtgtggccgtgtagtttctagtggcttggccctttccgttggtatcactcttttatctagatggacagttgctgctgatccccacagatcatacacaaactcctattcatccctcaaaacccagcctatatagccctcctgttacctttttgggagagtgacttgtgccccactttcacacatacctttatctgcctgagcatactaatctgctgttactgctcttaaccaacagccattgtttgggtttattccaggcaggggccaggtctcattcattccatgtctctccccaggtcccagtgtttgggagctgccctgcccccatgctaccccatacccagtccttcactgggcctggcttaggggttctcccatcttcagtaccccagggcagactctttcctgcttcgagggtgtggctgggacattgactctccgggtgatgtctgcccccatccaccggaaatactagtcccaagcctaggggtggtcctgcatgggacctggcccttggcttcctctgtccgtggatcctggaggtcataagaagggcttcttccctgtgttttgtttctgtgcctcagtttcaccatctgtgagatggggctactcctgcctgtacctcccatggcgcttatgcgcaattgacatgttaagaacacaccgtatgcccgacgcttggctcatggcaggtgcttggagaagtgaccatcgctgtaatagttctcccctgctcttctggcccccagccgcaccttgaggctgcaggtctcggggttttggctcagcctgaaggtggccaagagcatggctctgctcttggtgggccgggctctgggctgtaggcggaggcagctctaggttccagcttgagcccacctacatacctgctgtctttctccgggggctggggagggggagtgatgctggcctgccacgccctcctctctctgctgcagcccgggagcctgggcacctccgccctgcgaggagatcttggcaaaggctgcgtcaaatttttgttggcagccacatttcccagggcttggggtcacctccttttggccaatctggtttggggtcactggggacagtttcagtatggtgatggtgacttctgcggcctgtccgcctagtccttgccaaatactgagtggctgccccaatgcagctgagtcacagcaggggctcgcccgcgtgccagcctgtgaacacccatttgccagcacacacgcagtttagcctggtgcagggggcacccaaacccacgcaaattctgcccctgccctccgccacagcccccatgaagccaccttcaggagcccctccgccccccacctccctgtacccggctggcctgggctgccctccaggcctcctgtgagtggaccctggtggtcccaggctgcgggctggtgggcctggccgaggcacaatgtctgccttcacaccgagggccggggtgggggcccggaggtccagcctattgatggagcggccaccgagccctgcgccacatgttcctgttttcctaataagtccccagttgtgagtggggaggaggcggggaggccccggggcagcccagaaataatcacatgattgtgaaacacaagaatcctagaaagggtatctccgagcgcctctatctcaccctccctcctcctcctcctcctccttccctcgctggctgcactagctctgaggtaattgtagacaacccaaccagcttccagggtgagggaaggcatctcagggctggcagtgtcggctgggctggtggggagcggtgcccacgtcgctgggccctgggggagcgaggcctgcgcgcctgccggggagcaggcttcagtggacccggcgcatttgctaaaatcgaaacttggctggcttgctggggccgctgtgggggtattgaggctcctctgtgtttttttccagcgtggggagggcctgcagggggccccgggcctccctcccccgtgctgaggatcagcatgctggactgggctgggcaggtgcccgctgctccgggaagcctctatttataatctgtgtttttttgttttttaaaaaaattcctcctcttcgccatcaccctgcagaagaaggctgaagctgcacatcggattctggaaggcctggggccccaggtggagctggtgagctggggtacagggtcaggggctcaggggagggcgggggtggctggagaggtgggcagggaggcgggagggtgcggcggaggaggaagtcatctattaccaagcgctgcccaggcggcgtccgcggaggaagcaggaaacccaccttcctgatgagaggacggcagatagcgggtgggcgggcctggctgggctgggtgggggtggggagtcttggcagcgagcgcctccggggccacctgcgcactcctgtgcataccgtgaagcccggccgctcgggctgtgaggagagtcacacatccgtaggccggtgcgcttgctccagctgagcgcggagagccggttctctgggtcacacaatctcggtccactcccaggtgcaccgcttcatggcggtgtgaccctgagcgggtctgttaccctccctgtgcttcagtttcctcatctgtaaaatgggaatcctaacagcacctattccactggattacagtgaggaggagctgtgttaatatttttccaacatcgggtgccgcgcctgccttgtaaacagtaagtgctgggcattagctatgatgatgatgatgatgatgatggcgatgatggcgatgatggctgtcactagtgtccttttgctgcggaaagatgccatgtcagcagcagagctggaaagcaggccccaggcctcctggagtccctgggctgaggatgggtggatgcagaagccctagcccccagagaatgggccgcagcccctgcctgccccacagccatctgtgcccactgagctggtcagcatggatggccgtggtgggcactgaaggtatatgctacccacatgtgtgccggatgagggagagtctctgtgtgcatggtgggctagggtgtgcgtgtgagtgcgcccagggtgcagataaaggcttatgccttcgccatgtgtagtggctcatacctgtaatcccagtgctatgggaggccaaggcaggaggattgcatgaagccaggaatttgagatcagcctgggcaagatagcaagaccttgtctctgcaaaaaattaaaaaattcaccaggtgtggtgatgcacgcctttcgtcccagctacttgggaggctgaggcaggaggatcgcttgagccctggagttcaaggctgcggtgagctatgatcacaccactgcactccagcctgggcagtagagtgagaccctgcctcataaaaaaacgaaacagaagtctgacaccttcagagcctcaatctaaactcagctccactgcatgtttgccaagtggccttaggaaaggggctgacctcccagtaccacagtgctctctcatctgggacaggcggaggctctagggcctccttccagggtcttcccagggttaaaggcagtgctgcctgttaaaggctcacctagtgcagctcctggtccctacgaagcgctcagtagttgtgaacaatttggtgatgagctgctccccctgaagtttctgcaggctgctcagttttgcagtgagagctccccaaagcccggggtccgtcttttgaggccactcaggaactacaagccccgggctcccaggcccactcagaaggcagaagcagggaggagatggcaagggctcctccagctcagaagcagggcccagctgcccacctggctggactcaggaacctcgctgggctcccccaccccttcagggctctgccccctccaggcacatcctcgggcctgggcgatctgggtggtgagctctggcctagggtcgtgcttctctcagtggaagtgatatctggggaagttttcagcagcagcagctgctgcttgcttgtttttttgttttgtaaacagctttattgaggtacaattcacacgcatgccattcactcaaagtgtccagttcagtgggttttagtgtattcacagatgtgtgcaactgtcaccacggtcaattttagaacattccatcatctcaaaaagaaacccttctgtctctatggatttgcctattctggacatttcctataaatggaatcttgcaatatgtggtcctttgtgtctggtttctctcactcagcatcatgttttcgaggttcatccgtgtcgagcgtgggtcggtccttcgttcctttttgtggctgaatcatatttcactgtaggggtaggtcacgtgttgtttacccactcatcagtcggtggacgtgagattgtttgcatatttggggtattgtgaataaagttgctgtgaacattagtgtgccgtttccatgtgaacgtacgtcttcatttctcctgggtgtgtacctaggcgtggaattgctagatcctctgttaaccctgtttagccccttgaggaactgcccaactgttttccaaagtggccgaaaagtggccgtaccattttacatctccaccagtaagctgcctcttgcctcggtttctccttttctgccaaatagggatggcagggttggatgaagttcccaagcatttccagatttccgggtcctcccgctcccgtttcctgattggtccccgggggcctcctgggggaaagggcctgtgtcttagggcccgaggaacacaggcgaggaagcccctgtccgtgggagtctgtgggcagatgggggtgggcagctgctggtgtcagaagctttggaaccagggaccccacagtgagtcttctctggttctttggagacaaggggacggggttgtcttccacttggggatctcagagcagaggcttccacaaggctgatggcacaggaggctaagatctagtgtttggactcttgaaggcccctggcttggtgccagtcagtggggacagggaggacgcctcacagagctgttgccgtcccattttctggatgaggctcagtgagaggagtgccttgtgccgggccacacagcaagagatgaggcgtggaggtgtgctgagcccctgggagagcggccggccagttctgcacagatctgccaggcccgagtggccacaggcatcctccaagcagaggcagctgcatggtgcaccctctgcagggtcctgtctaccaactgggtgccagaagcccgggccagggacggcctgaggtgctgtgggtcacagagtccagttcccagggtgtcttccatcagaagctgcagttccaacgcccctcccctcggcagggacggatccctgtggccttcctggaggaatttgcattggaaaggatgaaaatagcaccagaggtgctaaccaggggtcgggggcactgagatggtggggcacggcccctccagcccagctgtggggactggaccaggctgggagcgggcgcagtggtggagggcgtgcccagcagccccgacctctctgccgctttgagtcattgcttccttcctgttccaaggcgttattttaagaagctggtgtcaccagcgggttgagggctggggctgtcacttcatttattgccagctcaggccgcctgggactctggctcttcctggtggccctgctggctggctcaaagcccgaggggggccgcctcctccctggcccctgctggctttcttagtcaccaccatgcctcatctctgcctgcgccctgcgtctggcacctgctcccctttgccctctttctgccctctgagtggctgtgcctctgattttagaggagacggaggctgagcaagagagagctggaccttggggcctcctgggtgccgcccctaccaccccaggctccacacgcatctaggcctcgattccctcactggcgtgagtccccccaggggtcatttctcccgggaggataaggcctgggggtgagggacaggggccagccatgccccccagcctgtgtggctgtggaggtgcctcatggccccatgtggggaccccggctagcctgggctgggagccgccaggcctttgtgcagccctctctgcagaggatgagggggatgttggggagtcccctcgggccctgcgtcccctcagcaatgcacctgccaggacatgtcactgtccctccctccccccactcccttctgggctttccaagatggctgtcctcagcctgttgccatggcggtgcacggcattccaggcagctctgggcccagagcctcccctgggctcctggggttcaggggcctcggggagtggctggtgagtgcctcccaggggggcagttcctgtttagaggccgcagcaccccacagtatcctcagtccttcggggccttcgccttgtgggcccctcaccgatggccgccttgagaagcaggggctgtgtccctatctacagggcaggggaggaggccaccaagtggaagtggccttcctcccctgtggctttggtgggttggaggctgaccgggctcttgctgcccccgggagccggtcctgcatttctgcacccgccctgtgccgcagaagcactgtcccctctgcccacctcgccctcccagggctgcgtgctgtgggcttccagcccctttctggcccccttcggctgtttgctatctttaaaaccaaaacaagacaaacaccaaatttcaccaagtctgaaattttctgggctatccaaaatttccgtgaagtaggtcctctttgacctacacccatattccagatgaggaaaccgaggctggagtgttgagggcacttgtccaagctcacagctagtgagggaggaggcaccatttaaattggggcctatctgtttccaaaacccgaacctttaagtgatgtccgcttgcacctggcctgcatttgattggcatgtggggaacataaaggagccagtgtggttgcccgggttacagcatgggcatcttcacagggccccttgccattcctgagacgaggattcgcaccctctgcagggatgctgcactgcaccccttccctccactgggaagttctgcagtgagtctgaccgtgggctctcttgttcctctgcccacttctccctcttgttcaaacttccagggtcagggtggggaaactgccctctgttcagggctgagaaccttgggaggggagcctgacccggcacggggagaaatggcccatggcagctgcaggatgacatctctgtccccaggagagtagctgagcaggagcctggaattgcccgagcccagtggtgaattctctaggaggggatctggggctacagggggaaaggcgacattgtcaccagccgagactgtctgtgaggctctgtagagctgcagaggcccttccctggggatgggtgggcgggggtctgggtggcccactctgccggcgtcatcaggaggtgtgttcagctctatccccagggaagagacttgtgtgtcccttctgtcgctgcagccctgccctgaggctgcaggactccacgtctccatccttccctgttccatctgatcactcacactctgtacctgatcttcccaccatagtcacccatggccaccctgggaggctcctgctgtgtgcatgggtgtgtgagagggagagggacaggaagagagggagacagacagacagaaagacatacacacacacacacagagactcaggcagagaggggagcagactccttcctccagcgctggggctgagaggcgggctgtcattcaggctcatctcttaccagctgtgggcaaatgttgtaacctcttaaggactcaatttttctttctgtacagtgggggatgattgtatcagttacccggtatggttacatggctactgctggggaacaaagcagccccacatttagaggcttgaagcagcaactgttcactgtttctcacctgtctggaaggcagctgagcatttctgctggtgtgggctcagctcttgcacctccgtggccagcgagggagtcggggggccggcgttgtagatcagcccaggctgggttgcaccacgctgctccttgcctctctgcccgcttcctgcaggccaggctaggctcattctcttgacagaaacagcagaaatgcgaactcgcatcttcaagcctctgcttttgctaagtgtgcagcaattccactggccacagcaaggtcatgggtggttacagggaggcgtgaaaggtgggtgccattagcacagccactgctccctgatggcggcaatgtgactggcacctctgggcacttcagcctgcaggtaccagcctgagagcttagcatgcactgtctcgtttgatcttcacaaaatcctatgagtttaaccccattttatagatgaggagaaatggaggcacagatggaataagtaacttcccagggagacccagctagaaagtatcagaaccgggacttgaacctaggctgtgcccttggttgctaagcaaggttcttccatctgggaggggacacgtggcagctggcttggtccctgcaccatcacagatgctgccgtgctttctgcgtctcctggtacgctctttgaagccctgtgcttgctacatgtgggccctgcctccctttctcactgctgtgtgggatttgtggtgtaaccgagtcctggtctccttagctgctcttctggtggtggacggctagcttgcttctcactggccgctgtgagcagtgcgttaggaacatcctagcgcccgtctcctggtggagcacagtaggcaactgcaggagcatgggggtcggaagcgggggcgtcggtgttcgttaccaggtagtggctgttgtctctctgggggatgtgtgcccatacaccatgctcccaccagctatgtgccagccttcctgtcaccccagacctcaccaacacttggcattcaacgtttttgtcttttgctggtcagtgggggtggagtggtatcttgcagcgttgggacgcgcgtttccatggtgagctaggaagccaagtggctttccacgtttggtggccagggccaatctctggggtgtgtgtgggtttgtccgggtgtgctctgggctgtggccccttccaggccagcactgctgaatgccccgcagagcagccatgacgaccttggtgggggtggtcacagtacccacagctgttcccgaggaaccagtttcagcctgttcctggctggggctgcgtgctgggtccctgtgttctgtttcatgcctgcctgcggctgagccctcacccagaggacagctcctccgtgccagggctgtggctcctaccggtgggctctgtagtggcgagtggccagccaggctctgatgtgcttctctctctccctttgcagccgctgtacaaccagccctccgacacccggcagtatcatgagaacatcaaaatgtgagtgctcgcgggcagccgtgcagacacacagaggcagggtgggcgagcaggctctcagcagcctgcatgggatgtgggacgtgggctctctgttcccatcaggggctcccggccagggccaggtgctcccggaggggacaggagacagtcctaggtggcacctggggtgggggtggggagcagagagagtgtccccctgaggttttgggagacaggctgggtttgggagggtgggcgagggagctgctggtgcacaggtgggtctggagagacggaggtcagaggtcccaggctgtacatctgcatcctgttcgagcaggagggagctgttgcgggcagaaggcagccggctcagggagatggggagtggccccagagcaggcgggggcctggtgttttgggctctggcataagcatgtttgggaatcacctggtgtctgcacagagaggtccctctggcacagcccactatggggcagatcagagcactcatccaggccctgaggctttggaggtggccaatgtgatgtattctaatgatgggggccttttcccagaccggtgctaggagggaagaaaatgtcaattaagtgccactgccattgggtgaggcggtgctggaggctggtagcattgtatcttcaagcggggtacaaggcattggaggtgtggcagctggaagggggctggctttttcttgggatgcattaacgggagcatagactgttgggccgaggagggcatgttatctcatgttagtgcccaggaacccaaaaggtaaaaggggctgcagatcttgccccttgaggaacatatggccacgtggtgggctggtaggttggaggtgagactcttcaggatcatagctgttgaatgttcaaggttcgtcatggtgagagggtacaggcgtttgagtgtggctgcaaagggaggcgtttagctgattcggtgggtagttcagcccggtccgattgttcaagcgttcctgggatggaactacagagtgtatatgcggtggtgagctccccgttcctgaaagcgtgcaaaccttccagtgttttcacacatctgctggtgctggactagtcgacggggagatcgctgctgttgtagtttccagagttgcgcgactggtccaagctcaggtgatcaacttggccacctggtcattgttgcagcagcctagaaaatctctccttgctagttgaggcccttggccttctcgggttcaggagcacctgacaaagatacttcaccagcgtggctggcgggggggtcatcctcagccagtggccagcaggggctgcagagtgtgtcaggaaggggcatgtgttctgcgccaggggtcccgggctggtacagaaggcccatgtcagatgcagcctgggctcctcatcggcctggcgggctcattcattgcccaggtcccagatcccttttgactcgacatagtttgtcttccaattgggctacccctgtcccttctgcagcttcctgggacctgccttgctctggggcccctgtctggggtgggaagccacagatggaggggtgctgaaagcaagggggacattcttaggacctcatcacaggtggtttaggggatgagggtggggtgttctcaactgagtccaggctgtttggggcattccctcattcattcatcccatctttattgagagcctgctgtgtgtcaggtcccgttctaggccttggctattcagccttggataaaacaaaggcctcatccctcatcaagatttgtctagcagtggagacagaaccagaatgagttaagtaaacaaaacaagagaatgtcagctaatacagccgggtgcagtggctcatgcctataatccgagcactttgggaggctgaggtgggaggattgcctggggccaggagttcaagaccagcctggccaaacatagcaaaaattgacaagaaattagctgggtgtggtggcacgtgcctgtggtcccaggtactcaggaggcgaaggagggagaatcgcttgagcccaggagttcagggctgcagtgagccgtgattgcaccactgtactccagcctgggtgacagagcaaaaccctgtttctgttaaaaaaaaaaaagaaagaaagaaaaaagaaagaaaataccagcgaatctaaagtactatgctgacataactatcttaagctctttacgccttcatatacctagttatgatttttctttttgacataataatttttgatagccatattattatactgacaattttacataggtttttttcacttaaagtgagtgatattttaagctgaatactgtggttgatttcaggtaataaagacagccatagaatctaaacaaaagaggagcaagatgctcatatagatgacaccagcaaatagatattgcttcatctttgtgtaagtagaataaaactgtaagcatattaaagccagtgctgtatttgacatctcataatcttcctcagagaatgactgtggtccgttgaagtgcattttgactaaataggtaaccgcctcactgaatttgttccaaatctaaatcacaaacaaacatgtttctatttaaaacaactagatgtgctgggcgcggtggctcacgcctgtaatccccgcgctttggaaggccgaggcgggcagataacttgaggtcaggagttcgagaccagcctggccgacatggtgaaaccccatctctactaaaaatacaaaaattagccggctgtggtggcgtgtacctgtagtcccagctactcaggaggttgaggcaggagaattgcttgaacctggaagatggaggttgcagtgtgccgagatcacgccactgcactccagcctgggcaacagagcaagactctgtctcaaaaaatatgtgtaatatagtataatataaaacaaatagatgaataattaagatttcctacactgtaagtagtcaacttctgttagaaaaacctttgtgtgtaaattgttggaactgatttgtcctaataattttagttttttggatattttctactaaaattatcatcccttctattttttagatttcaatctggttatcattaaatttcattgtgcagtcattcattttttaaaaattctattactctggtaagtggggtaatgggagagaaaatgagggggtgacattagccagagaggtcagggcaggccatgacagttaaggggacccttgtaggctgagcagcagctggctgtgtggacctctggggagtgtcccagacaggtggaacaggaggtgcaaaggccttcctgagctggcaggggtcacagagaaggctggcatggcccaaggaggtaggcaagggagaggagggcacaggccaggtcacggggggctggtaaggagttccggttttattatctgttgggataataatgatgaagtttataatagtgatgaagtttatcccaggaagcaatgtgatcagacttttgttttaaaagttcactttggtggctgcagggaggaaggacctgggggtaggggtgagaataccatgggaaggcccctgcaggagctgccgaggtaggtagtgagcaccctgtcactgggaggtttgcaagctgagggtgcataatgttcaggaaatctgcagtgcccaggaagctgcccttggcagcctctgcaccctgcactccttgcaggctctgatgttttgtgaccgctcatgctagactgcagaaactgtctcgtgtccagtgctgggacatgggaagggaggccccgtgcaggccccgtcccaccatgtggctggacacagggacctcaagtgggaccgcagctcgtcctggctgtttgactagctgtgtgtccctgtgggaagtcacttgccctctagggctcagtttcagacgtgctcactaaggtcagtgctcagcacgtacagcacatactactgggtttttggttcttctttcttttgtctacagagacccagactcattcattcgacaaatatttactgagcatctactacacgccaggcactgttctgggcctctaggagataggagtgaatgaggcctgacattctagtaggggaggctgataagaataaatacattgtgataagtgactgccgccatgggacaatgagatgatccagccggggtcaggtggggctcccagcttcccctggagcagcctccctggcgctcacggcctcctcgcccccgctgctgtcattgcttctaggtgggaggtcgttccctccccagagaccttgccccgtcactttaatttctctgcgtctgcatgctggggccgcggagtgaaagttaatttcacgcttgacttcctgccgcacagacgatttcggacgcgttggagtcgcccgtagccgcctccgccgccctcccaccgccacctgcttcgggcgctgctggtgtcccctgctgcaggagggagcgctcagaccaccggggcggggccggggcagccgcagaggggcaggagatgggggctccatcgagggatgggccccaccctgggcaggatgctccaggaattcccgggagtctatggagcccgcgtgggatgtggtgaaagtgcgtgggacctggggatgagcggcagatggcgctcaggcacattctgcctctgcctgcccgggggttgccctggttcaccggccccctcaggcctggaagccggtttcttccgttgctcgtttttctcttttcgcagcctgatttcttccctcctgctgcctcatttgggggtcggctgatgggaactgtcagacccggggctgtgcaggcggaaagggggatcagtcagaacccaggttactcttagcaggtctctctggtcttgttcagagacatcagatgactcccccagggtcacacagacaaattcctagaccagtcctaactgcacatccagccaacttcctctcctgggtctctactccaggccctgcccctccctacctgggtgaccttagacaagtcacatcacattgtttggcactgtcacagcttttggttggcgctcagtgatcaggaggttcagaccatcaccccaacccgcagtctcttcccaaggtatccgggccctgcatatctgcctccctcttcctctcccctgcagccggggtcaggctctccctgagcaccccttctgccctctccagattcactattgctgcctccctccctagaacccagggctctgctcattttcttcttcccaccgcattcctctgcttctctcaggcctcagctcaaacctcccttcctccaggaagcctcccctgattgcccccaagctttccttttccagtaccccataaaccccaggaccagtcccagctagggtccaaccggactcccctggaatactctcataattcctgcctccttatcctgccctcctatgtcctgcttctcctctccagtgccctggcagatggcaagactaggtttccttatagggtgtgtgtttttaaaccctgacttctttgcaccccatgagtgcctctaccagcaaactcatcacatgctgcttaccccatgcctccagagccctcctacagactgtggtccttatgcttgccggacagaagctcagcagaaaagatttgtctgcagtaagctatttgcatcttcattgcctaaacactgcttggaacaaaataaacacttaaaaaaacgtttgccagaggaatgttgaacacgtgggcatcataaaccaggagtcccccaggtggctgcctccaggagcgggaaggaaggtttgagtgaggagggctggtgtgaggcaatagggagtagtaggggctgaggaacggggagctgggcgacctttgaaaggagcagccaagcctcagtttcccagcctgtggccatgaaggggtgtggcccgatggcctgatgttttcaagagaagctttaggtttggctttttgtgtaacagcctctggttttcagtgctggcaatgaatttaggattttagaaagcaccagccgggtgcggtggctcacacctgtaatcccagcactttgggaggctgaggcaggcagatcatgaggtcaggagtttgagatcagcctggccaatatagtgaaaccccgtctctactaaaaatacgaaaattagctgggcgtagtggcacgtgcctatagccccagttacttgggaggctgaggcaggacaatcacttgaacccgggaggcagaggttgcagtgagccgagattgcgccactgcactccagcctaggtgacagagcaagagactccatctcaaaaaaataaaaaataaaaaataaataaataaagcaccacagcccaacacaacaccctcagaggctgtctctggcctgtgcactgtgcagtttgcaccctgcggacttgacatgtgtttgcagacttgacgtgtcctcttgcgtggtacgtggatgtctctgggtggcaggcagtgtccttgctttgggaggaaacctggatcagccagggtggattcacaccctcagttgctgcccatcggtggcaaacagacggctgcatgcacatcaccaccaccccgaggcctcatgctcaccgagtcgttttccagctgcagtgacagcaccgcggtttgtggaagatcacacgccggactagcttctcagcgctgccttaacactcggccgtgaaccgggcagctgaaaatggcaggaactttcttctctcacagtactggaggccagcagttggaaatcaaggtgctgcaggaccacattctctagaaggctctgggggaggctgcttccttgccggttccagctcctggcggctgccggcctccttggcgttccttggctgggagatgcgtcactcccgtcttttgtattcgtgtggtgttcttcccgtgtctgttcgcgtcatctcccctccgtgtgtgtctgtctttttgtccaaatttccccttttcataagtcattggattagggcccaccccagtaacctcattctaacttgcttctcgctctaaagactctgtttccaaatgaggtcatgttttgaggtgctggggcttaggactttacacatatcagtttttttgtagttggggttgggggtgacattcccacctgtactaggcagtgtaccacctgcaaaccccaaagtcaattttgtatggtcttcaccacggtgtttcaaagtggattctatctctcttcttttgtgagaaggtggaactatttattttgaagtaactagattgtacgttgtgcaacagaagagttgcaaatacgctccacagagttcccccacacacgtcacctggcacccctcatgtggacagcttatataacagcagagaaacacttaccacaactagggcctgccatggtggcccacgcctgtcatcccagcactttgggaggccaaggtgggaggatcacttgaggctaggagttggagacgagctgggcaacaaagcaagacctcatctctaccaaaaaataaattagccaagtatggtggcatgtacctgtagttccagctactcaggaggctgaggcaggaggattgcttgagcccaggagttcaaggatgcagtgagccatgatcgagccactgcactcccgcctgggagacagagtaagaccctgtctctaaaaacaaaaatcaaaacaaaacaaaacaaaatactaagaaagaaatagtggcacatgaccctctgctaaactaccagctgtctttgcattttcacccgtctctccgccaacgtctgttttctggtccaggatctgattcaggttctcacgtgacatttgtgctcgtgtctctttagtctccagcccgtgacggcttctcagccttgccttgtttttcaccaccccagcacttttgaagatcactggtcatggctttctttgacaggtgtttcctcctggtaagactgggatggtgggttttggggaagaccagagagaggtaagggggctgcgtgatgcccacatgatagggggctctgccctaggtctccgctgtcgccttagagttatccctcctttgctctgttctttactagggagtcaccaagtcccacccatcttccagggcaggggagttaagctccgcctcctggagggaggaatatagatttgtggagccaccgccatgattcatacatacttgcggggagattctttgagactgtgcaaatttcctgttgctccttaaaattttgccaaccaatttagcattcatccccggatcttgccagcggtggttgggttattactgcgttctaatgacgattttctgtttccctcctctcttggacatttattcattggaactctagaagaaagatctgtcccttctcctccatgtattgatgtattgaatcatttgtttgtaatcacatggactcgtggggatttgttttattcctgggacgctaatctagtcccagggttatttctgttgtcactcacattgttccagctctggcagccggaaaccttcaggctgggttctgtgtccttttgacttttgttttcttttgtttttggcaattcttgacttaaagtcactctgggctcttcttgcatacttcctggccgagcgctggaatcagccatggcccgggcagcgcggtttctgggattggaggatggtctttgctgagatatgggtgctgctgtgctcatggcgcctgggccttcactgcttctaggccttcacagctgtcttttgcataaaagaccaaaccctttgccatgtcgaaactcacaggaccctgcaggactggccctgccagtcttgctcacagcccctcctccgtcctctctgcccctccccagcactgtccagccacagggccttcctctgtctgtgcttccgatacacagagtttgttcctgtctcctgcggtgccctccagctggagttcccttccttctggatcttcccagagccgggtccttctgatgacgtagatcccagctcaaggccatcctctctgggagatctttctgcaccacggaatctaaaatagcccctcacaccccgtcccccagcacccactagcccaccattccatttaagttcccaaatccaggattatcttggtcatcttgcttattgtcagtgtcacctctgtgagagccctcaactgtgtcttgctccctgctgtgtccccagcacctggaacagtgcctggcacatagtagatgctcagtaaacagttattgaataacagaagatgaggctgcgatgccatagatttcagatgaggaaactgagggcttctgaggtgtgctcagagacaccctgttatgagatgaagggtgctggtcctagcctgtgggactgaggacccccatggcccaccctggccggggggcggcggccagactgatggaaggtggggaggccctggccaagtcaccaccagaatgacccggggactgaggtggattccaggcccttgagccccatgaggcttcactcgtccgtcagagcctggggttccctccttttcctgtttccaatggggctggggtcccgggggctggacatagcgtggctcccagtcagtagctttggaacttttgagggggtttggacactgctgagaatatgaaaaagttggggatcccctccccagaaaagcgggtgccactgaatgccgcggattggggacagacagcaagttaaggtgcacagcaggctcctgaggtcgctgtggccccccaggccctgggaggccagctgcagcaccctgctttgtgtgttggagaccgtggggaggggcctgggaagagaagaggacggtcctggggtctcggtgcagcagtgggtgggggtgtcttccagccctcatggcgtgggctccagaacctcccgcctctactctccagggctccctccctttgcctgtctcagggtccctgtcccctttcttcgggtcttgtctctttccctctccccacttctctctctttccctctcctagtttcatcttcctctgagtctctgtccccttcctttggatcttgtctctctgtgactgcctctctctctctctctgatcctctctttctcatctctctcactccagtctcacctctcagtctcatctcctgtccatctccaggtctctgtcctttcttggatctcatctgtctatctatctccgtctctgtgtctccccttctcccagtctctgtctctttctcacctctgtctccctgtctgtctccctagtctctgggtccctgtttccctctctgggtctctgtctccgtctctctctctctgggtctctgtttccctctttctctgggtctctgtctccctctctctgggtccctgtttccctctctgggtctctgtctctctctctctctctctgggtctctgtctccctctgtctctgggtctctgtgtctccctctgtctctgggtctctgtctccctctgtctctgggtctctgtctccctctgtctctgggtctctgtctccctctgtctctggatctctgtctccctctgtctctgggtctctgtctctcctgtctctgggtcactgtctccctctctctgggtctctgtgtctccctctgtctctgggtctctgtctccctctgtctctgggtctctgtctccctctctctcagggtctccgtctccctctgcctctgagtctctgactccgggtctctgtctccctctgtctctgggtctctgtctctcctgtctctgggtctctgtctccctctctctgggactctgtgactccctctgtctctgggtctctgtctccctctgtctctgggtctctgtctctctctgtctctgggtttctttctccctctctctgggtctccatctccctctctctggatctctctctctctctctctgggtctctgtctccttctctctgggtctctgtctccctctgtctctgggtctctgtctccctctgtctccgggtctctgtctccctctctctctgggtctctgtctctccctctgtctctgggtctctgtctctctctctctgggtctctctctccctctgtctcagggtctccatctctctctctctgggtctctgtctccctctgtctctgggtctctgtctccctctgtctctgggtctccgtctctctctctctgggtctctgtttccctctctctgggtttctgtctccctctgtctctgggtctctgtctctgggtctctgtctctccctctgtctctgggtctctgtttctctctctgggtctctgtctccctctgtctcagggtctccatctctctctctctgggtctctgtctccctctgtctcagggtctccatctctctctctctgggtctctgtctccctctgtctctgggtctctctctccctctgtctctgggtctccgtctctctctctctgggtctctgtctccctctctctgggtctctgtcttcctctgtctctgggtctctgtctccctctgtctctgggtctctgtctccctctctctgggtctccgtctctctctctctctctctctctctctctctgtctctctgggtctctgtctctctctctctctctggttctctgtttccctgtctctctgggtctctgtctccctctctttctgggtctctgtctccctctctctctctgaaactcccgtctcccaggacgtgcctccttctcttggagcctgcagtggtgtgtgtaacctgcttggttgagaccccatgggccctgccctgaagtctgagaccgcccccgcccgggggtttcctgaagtccatgcctggtggccccaccagctgccccacactgcttgtgtccctccccccgcagcaggactgggtgtgctggaggtccatgcacagcacctggttggagccaatcctggggccacacaggccacactctgacacccggcctgtgggcggcagcaggtctcggggtctcgggctctgtggcctgtattcctagttggaggctgtggctgtttctccgtggccatctttccgtgggcagatgtggctgccggggtgcatgtgggcgggggcgggaagccacaggcccctcggctctgggaaccctcttgcctgcacactgggctcaacctaaacgttggcgggggctgcctcgcgcgcgggggagtaaggatgcacgttggcagctcacaggtctctctggggatacagcacgggtgggtctcatctccctgagaaccaataacggggcaaatttggggctcactctcagcaaacaggatggcacggggtgcagcgcctgagcccggccgggctgacctgtctgccgcttccctcctgcacagaaaccaggcgatgcggaagaagctaatcttgtacttcaagaggaggaatcacgctcggaaacaatgggtaagtccacaccgtggcccccatcagctttccttgagatctggggagaatcgagcgcacagggggccacacctgccggggccctgtcagttccgcagctgtgtcctccctgagtgtccaggctgcggaggaaaagccaaggccggccaggaaaggaggaaagacaacagctgcttccagaaggccccagggtgggtgggggtgggggggctctatggcccctcttccagcctggaagggaagaaagcaaaatgttggcctggaaaattagttgctaagccctggtcacgggacctgtcctgggcttttcaggcagaaagagaggttttggagagaggtggaggatcagggtgggctgtgtgccgggcagcaggggccgcaggcgcacccttacaaatgagcctttcctggtgcactgggcccaggtccaggctcagggaaactgagacagtggacaagcattgagccccctttccctgagcctgcatttgtggccagtggcctcatccaaacagaaaaggatgctgattcctgcttctcactgtaggctgtggatctcagcccacggcggggaggctgggtctgccagaggcatgtggtggtggtttcaggcggccgtggccatcacccattccccggaggagatcagggttgagtattctcccagctgtcaggggaagaagcgcggactcagatgggcttcaacaggaaaggaatggctgtagctggaaatgtctgttgggtgtagatggcaggaatagtctttcaactcaagtcttgccttcatttcatttcattacatttcatttcattttatttgtttatttatttattatttatttttgagatggagtttcgctctgtcacccaggttggagtgcagtggcagggtctctactcactgcagcctccgcctctcgggttcaagcaattctcctgcctcagcctcccaagtagctgggattacaggcgcccgccaccaagcccggctaatttttgtatttttagtagagaaggtttcactccattgaccaggctggtcttgaactcccgacctcaggtgatgcacccgcctcggcctcccaaagcgctgggatcacaggtgtgagcactgcacccagccccttcattcctgtgcagttttttcaactccttatgttagaacattgacaaactgaacctgaattcccatagcaggtgggagccggagagagctgtgctttctcggatggtatcacagatgctctgattaggccaggagagggcctgcgtcctgtgaaccagtggctgatgccggggagatggagtgaggctgcctggttttggctcatgggactttctctacagttggggatgatgtcattgactccacccaagccacggggctgctgggacatggtagggaatgggataaggctggggaggccctgaaaaggtccccacctggggaagaggcgggctggatggggactgctgccttgggattcttggataagagacgcggcaagggctgggaactaggtttgctggaggctggaggggctcccctcatacctgcagccccctgccccacctcctctctccctcagctgtgttgaggcagggcctgcgaggcagctccctgtatcctttctgggcctccagagaggccctcccaggcgcaggcctggctcagtcatgcccagcgcctgtaggtctgtggtacacagtaggtgatgaccaagtcctgcttgaactgaaatgggccgggacagggtgttagctgatccagtgcctttggggcctggatgccagtagtcacggagcacctactgtgtgtgaggctcgcagttgctgtgacacgggccctgtcctcagacctgcaggctgcagggacaggtcgtgcgtaaggacgaggaggatgcccgcacaccctgcccttccggtgcctgttgtgttgcaggcgctcttctgagtgctctccatacattagggcatttagtcctgcgaggtgggcgcttggtcagccacatgtttcagaggaggaaatcgaggcacagagaggttaagtaacttgccctaggtcacacagctgggaagtggtggagctgagatttgaacccagaccacctggttcctgagcccatgctctgaacccccaaggggcagttccgagagagtccaggagggtgtgtggggtatggtggtgtggtgagcggccacatggtggggctgagcagtgcctggggagggggaccctgggcaggcatggggtcctgggcaggtgtgtgggcacgtggggccaggtgaggggcttagctggggcaggaggtcctggctttggaaggaggggctgtgctatatgggaggagggtcttcccttggccctgcctgcctgctctggccccgaacttggttgggtactagagggaggagacacttccagccagatgctggtgcctgggaagctgcgggcagccctcgggacccaagccctgctcataggtgaggagaggtgggctgcccagcagtgccttgcccagcttcctcagatcccccaccttgactggatggtgcccacaggcacttgggctggtgcgagaggctcttgaaacgagcgtccaatctgtttatcaagttaagagatacccacacagggctgctgggtgcccgggagtcacaggccaggaaacagaccggtaatctggggagaagagctgcacagagggctagactctcgagatgggctggggacctcagtgctgaggtgggaatgaccagaaaggactggctttgtgcggatctgggagtcagggtgtcaggcagagggcatagcaagtgcagaggccctgaggcaggaaccagcttgggacagaacctggcaggccagcagcaggagccaggtcgcgtggaaacatctgccctcaggctaggatggaacattcaggttttattccgaatgcagtgggacaccgaatttattcttaatacatgtatttgtagtaaagaatccaaagtccttattctaagaaatttgacagaagagtacaaggcacatctatatacccaccacctagaatcagccacggttaccattgccttgtatttgctctgtgtgtataacatgtttgttgttgcactattggaaaataggtgcagaggtgccgaccttcacccctaataaatactccccctctgtctcctgcgaggaaggaaatcctctcattttcacctaaaatgactgccaattcagcgcgatcttgccgcctccttgacagccccccatggttccccccttggggtgaaggctcctctcgggagggcaggagaggatctgatttccatttaaaaggatcgctgcagctgctggaaggagctcaggctggaggtggagttggggtgggcttgagttctttaaagatcgccagtggctccttggggggtctgtggagggggtggagggagaaattggcttatttaaagctagagaagaggcaggcagaaaccaaggacttccaagaagggtccggtgtggctttgtggcccatcttaggagggatggaaacaaattcaacaccccctgaagctgcggtggcgattgggatggtctctttgttgtggtataagaagccgaagtccctgacttcattgatttcagtaaggcctggggaggggggcttggccgagaactctgatgtgcctgcctcacccccactggggagtcagacccccctcagaccctgggacccccacaccttagcaggttcctggggacccccatacctcttcccagagagcagggcctcgtccctgtcatgggatcctcagcaccagcacagccccccaagcctgccacatctcctgggaagctgagctggaccctctggaggcccagttggctgagagactggctcagcctgtggtcccagaggcatggctggcctgcttcttctccctagtggatttgcgctcctagcaccccgcagactagctggcgggggtggggggcgggagggggacggctccagtctttccctgtgtgtgtgtgtgcgtgtgtgtgtgtgtgtgtgtgtgtgtgtgtgtgtgtgtgtgtgtgtgtgtgtgtaagacagagagagggagggagggaagggaggaagggatctgtttcctcccctggccagtgggtctgcccttgtagaaaaatgccagtgagcatcttccctgctacccaggccaggccggagctgcccgccctgcgctgtccgaggcagaccgaatgcacacccagcacagtgtctngccacaagtacagcaggtgttacctacagccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaaaaccctcaccagccactgccccgagcactttttggccgttgtctgtcaccagaactgcctcttgatctccagcgcgttcctggcacagcctgcatgcatggggttaggttctgggccacccagcaccagcctggccacctcgtggggaccgtcatggtcacggggctgtcgaggatggagggcacagcttgcccttggtcagcagctgaaatatggggtggggtggggctgaggtgtctgggctccaggaccagagaggggctttctgactgtaccgaagcaccaagtgggtgtttgtggaggctcccagatcacaccgtctgtccacccccagctgttagaggtggagtaactggggttgtgtgggtggctcgccctgcgtccccttccccgcccccaccccccgccccccgccgccacttgctcaagtcaccttggagatgtggaagccaggcagctatgctctgggctgattggggatctcttctcaaaggacatgcagcaggcagcactgtggttagatgtggagagggacttccttgtcttggagggaaggcagagccccctctctgggagctgctggggtcctcacagctggtccttggggtgaggctggggaatgaggaactgcttggaatgtggttttctctggcggctgcccctccccagggctgacgggcccgcatgttgtacagcacagcttcctgtggtgtggcagtgggctccatccgggctgtctggtgcggccggagccccagccgcatgtggctgctggacactggaagcatggctggggagaactagagcccgactcttaaattttactggatttgtgatttcagttgagccacacatggtgggtggcttccatttgggaccaggcctctgcagaggaggccaggtctgggtggccggttcaccaggaagggaggtgaccgtgtcctcaggggaagtctgtgggttttcttcaggggcccccgtctgctggatagccatgcaactatgtgcctgtctttctgtcgtctgcctgtgtgatgtgtgtgtgtctgttgtgtgtctacatgtgtgactctgtgtatgtgtgtccatcatgtctgcctgcgagaccctgtgtgtgcatctgtttgtctgcctgcgactgtgtgtgtgtctgtcatatgtctgcctggatgaccgtgtgtgtgtgtctgcctgcctgtgtgaccgcctgtgtgtctgcctgcctgcctgtgtgatggactgtgtgtgtgtctgtcatatgtctgcctgcatgaccatgtgtgtgtgtctgcctgcctgtgtgactgactgtgtgtctgtctgcctgtgtgaccatctgtgtgtctggctggctggctgtgtgacttatgtgcctgtgtatatatgtgtgtgtgtgtgtctctctgtgtatctgcctatatgactgtctgtctgcctgtgtgactgtgtgtctgtctgtctgtctgcctgtgtatctgtctgtgtgtctgccatgtgactgtgtgactgtgtgtctactgtgtgtgtaccgtgtgggtgactgcatgtgtgtatgtgactgtgtgtgtctgtgactgtatgtgtgtgtatctgtgtgtctgcctgtgtgacttgtgtgtgcctgtatgtatgtgtgcctgtgtatatctgtctgactgtatgtatgtgtgcctgtgcatatatctgtgtgtgtgtgtctctctgtgtatcttgtgtgtgcctgtatgtatgtgtgcctgtgtatatctgtctgactgtatgtatgtgtgcctgtgtatatatctgtgtgtgtgtgtctctctgtgtatctgcctatatgactgtctgtctgcctgtgtgactgtgtgtctgtctgtctgtctgcctgtgtatctgtctgtgtgtctgccatgtgactgtctgtgtgactgtgtgtctactgtgtgtgtaccgtgtgggtgactgcatgtgtgtatgtgactgtgtgtgtctgtgactgtatgtgtgtgtctgtgtgtctgcctgtgtgacttgtgtgtgcctgtatgtacgtgtgcctgtgtatatctgtctgactgtatgtgtgtgtgcctgtgtgtgcatgtctgtgtgactttgtgtatctgtgtgtgtctgtgactgcatgtgtgtctgcctgtgtgacttgtgtgtgcctgtgtatatctgtctgactgtatgtgtgtgcctgtatgtgcatgtctgtgactgtgtctgagtatatgtgtgtttgtgtgactgcatttgtgtgtgcctgtgtgacttgtatgtgcctgtgtgcttgtgtgcctgtgtgtatctgactgtatgtgtgtgcctgtatgtatgtgtctgtgtggctgtatctgactgtatatgtgtgtgcctgtgtgactttgtgtgtgtgcgcacgcacctgtgtgtctgcctgcatgtgagtgggcaggggggaggcggcgggtgccaggtgcaggagcatcttccgcagtgccccctgcgctctcccaggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagaggtgagcggggcctgagcccagggcccccgacgtcagggcccggggtcagctccagcatcctcagtagagatggcctggccaggaaggaacagaacagcacagcagcttctcaggccagtggccagggccctaccagaccctggcctgtgtcacgtggagcctctttggcctaatacttacttggaacttaaatacattttggggacaagcacttcttcccatgtgccatagcgtgcacctgccagcttcactcatttctggggcctgcacgacccctgaaggcagctgagtttgagatccctggtgtgggacaaaggggagagacgtggctaagagaccacgctgtcagcctcccccagtggctgtgaggactgggtgggccccatctgagaggtgcctggtgacaggcagctgtggttctatggccatttttctttggatgcacagataaggcgattcattggtaatgataacaacacctttcacccttaactgaagtcacaagccatgtctcattaagttccccacaacagctctaggcagccaggtgccacttttgaatcctcatatgacaggggaggaaactgaggcacagagagaaacacttcggcccagggccaaagaggcagagctgggctttgaacccagatctttgtagctgggcttttcagggtgttttaggagagaggaagggactgagctgcccatgtcacagggtttggccttgctgggttggggtgggggctccatgcctccccaggaccccgggtgtggggccggcccctctgctggccgctgcccacacttctcctctggggagggcgtgggctcagggctgcgccacaggggtctgctagtgtccccgaccaccagaagaccggtcctgagtgtgtccccttggtccccagcagggtgggccagcggggcagtgggctgtccatgtcggccgcccgcagcgagcacgaggtgtcagagatcatcgatggcctctcagagcaggaggtgagtccaggccctgactctggcctcagctccttttccctggcatcccccgtgagggtgcagaggccctagccagaaaccacctcccgggtggtttacgtcgaggggctttgccaccgaagcgcgggtggaatcaaggtgggtattgaggtacccgtcccaggcctgcaggggcgagcagagagaggggtgttaatgtgtctgagagggagggtagcaggaccccctgcagggagggccctggcgctcccccatccagatgccacaacagggagggggttgggggacgaggaccctgcctctcactcttcccatctcctgcctccttttggaacttcccattggctgagtccagccagaagcccaaggggcgggagtgcctgtgggttccagggtcagccttccagggcccagagcctggcagggtggggggagcatggcgcaggccgaagagttcccagcacgccagctgtccacgcagccacgaccttctcgcaggcacctcagccctcctggctggagcagggccggtttcccctcaggcctctttggggtgccaggacaccctggggtcagcctaggtgaccctggctgccgtcactggggcccacagatggccaggaagcagagaggcagccttttctcctggggaggaagttggtgtcagcctgttccctcccgggtcctgtgggtcaggtacccatgatgagactaccccctgctcctaacaccacagcagacacgaggcagccacggcacgtttcttccttctggggacttttgtccagggagagcttttgtccagatgggagattatagccctttagctcagcacagcagagccacgcatggctattgaaatcaaaattaattaaaatgggataaaattagcaattcagttcctcggttgcatctgacacatctcaagagctcgacagccgcttgtggttggcagctcccctcctgggcggagcagacagcgaacacctccctggctgcagagtgctctgttggacaacagaacgcgctgccctgcgatgctgatgctcagattagacagatggaaggggccccagggagggggcggctggtttaagtagcagtttctcaccagagactctgattcagctggtctggggcagagcccaggaatccgcatttttacccagccacccacttgattctgacgcaggcaatccaaagatgaatctggccattaaaacataatttttcattttaaaacttctcgtggtacgtttttgtttacaacaacatccagttgacagaaaacagagctcagaaagccatcgcattgcacagccacagggcccggccctcgaaggctgggcgccggagctgggccgtgtcagcccctgtctcaccgatgctgtgcacttatggacatcccgcagagaggctggctgtgggtttagtctgcactggaaggaggaggccggtggccctctcctctgcattcctcacctgatggccaagggtgtggcacctgggctgattgttgcatgtacacacacacacacacacacacacacacacacacacacacacactggccacatgggaatgcagtcatcagagtcctcagggacatcaaggatgctgtgtccggggtgaagggtggaagtggaatttgggacagaaacttccccagccagcctggggtgacctgaggttcccccgggagtgtgcaagggagggggctgggccggaggacaggcacttcccatccttctgggagcttcctgtggtcagagcacatggccggcatgggaaggacaggaaggcagctgtgggagggcagagcagaggtcctgcctgtggccgtgccgggggtcctgccattattacatccctgggatacccgaggaaggtcgccgttccgtatcaggggtgtaggggacagctccaagggtctgggagacagatgccagcctcttggggggattctctcccaccccggggtcagagctgtgccccgcacccgacctgacccctggctgggagtcctgcacattgagtgaagaggttggatgtgggcggccgggcagctggatcgtttgaactggctgaccttggctacgcggagtcctcgcctacctccggagatgggtaattaatcgccagtaattggctggctgcgagatttggggaagtgagcccagctgagtggcggctcagagcctcttaatagtcatcccagtgcattaggagcggccgcctgactcctgccgcatgcagggctgggcaggccagatcccaggtgggccctctgaaggagcggggtgccgggagggggcgtgtagtgtgggggcaggaaagacctctccaccagcgaggcgctgaccctctctgcgcccctgggctgcctgcatgctgtggggccagctggaccccagggcccactcttgcctgcggaacctggaaggccagcctgtctcccgggctccctgggcccagctgggctgagcatccttcctgcagtgctttatggcgcttgcatttccaaagggaagattcatggctcccctcccactgcagagaaggcggctgctgctctctgcattgaatctacagtcctgcccaccataaacctgtcggggaggcctttacattctcccttcccccagcatgagctattattatttttaaactcatcattctccttctccttggtttcgcgttttccctgctctggcgcagaccatccgtcccctctgtgtcttccctgggtcccctgcgccggccggagcacctcgtccctgggcctctgaccctgccctccgtttccctgcagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagtgagtcctccatcacctggcctggcctcccggccccccacccccatcctgttgaggcctgcgctgtctcccggcagccaccacaaatgagcatgccggggggtgcttaaaaccgcagggatttactctctcctggttgtggaggccggaagtccaaatcctggtgtttcgtggggttggttctttctgggggccgtaagggagagcctgtccctgacctcttcccagctggtgctgccagcatccttggccttccggggcttctagatgcatccttccatgctctgccttcgaccccacatgacctttgtctctgtgcttctcctcttcttataaggacacccgtcacactgaatttagggtctagcctaacccaatacaacctcacttcaactaattacatctggaaagaccctgtttccaaataaggccgcattctgaggttctgggtggccatgaattttaagaggacacacttcaatatggtacaaagtgtaagggcagctggatgtaagacggggcactgcgagtcggaagaacaaggcaggagggacttagaggctgggccgcagccttgggcagggcggcagctggccagtggcttttggtggtttctattttgttttgtctttgacaatagctgctggctgagtgggttcgtgatcccatcactgtgcctgtgtcttctcagcttcatgcattttccccctcctgtcccttatgacagctcagccaggcccaccccagtacacagctgatgacacggaggctcagagaggttcagacagtgcacaaaggccacacagcatgcacacaatggaggcagggttcagactcctccagctggaatggagaggctgtatagggaatggtttgtgaatggggccagggaggggggctgtgcagagcagagacgggagtcgagttctctcaaaagctgtgtctgagggggccaaaccccacagtgagaatctgcgatgtgacatccaggcagaaggagacctccatccctggcccggggtccccagaggagatcgtgggccctgctgagccaccccacgccttagggacagtgtgctataattccggggaatctaatcttttggcttccccaggccacactggaaaaagaaatgtcttgggccacacagaaaatacactaacattaatgatacatgatgagctaaaaaaaaaatcacaaaaaaaatctcataaggtttttttttcctttttttctttcttcttttcaagacagagtttcgttctgttgcccaggctggagtacaatggcacaatctctgctcactgcaagctctgcctcccgggttcacgccattctcctgcctcagcctcccgagtagctgggactacaggcggccaccaccatgcctggctaattttttgtatttttagtagagatggggtttcaccatgttagccaggatggtctcgatctcctgacctcgtgatccgcccgtctcggcctcccaaagtgctgagattataggcgtgagccaccacgcctggccaaaaatctcataagggttaaagaaagtttacgaatttgtattgggccgcatttaaagccgtcctgggctgcatgtggcctgtgggttggacaagcttgctctaatcacttgcacgtagagggctgggttccctgcccaggacatagagcacctcctcaggacctcagagctctgggaggcaggagagtgggaaactgaggtgtggacggaggcctctgtgcttggccaggaggggacgcagggaagagactttgtcactgcccgacgttcacccggcaggctactgagctgccttggggaagaccctgcctccggacaagagcttcctccaaagcaatgacactccttccccagtgccctgggctttggtccagggttgtggccccaaagaggtgccaggcaggacctaagggatggggtgactctgggtccccggcaggggtgagtggacccgcaagtgcagataccgaactcagaaaggacacagtggctatccaggagggtctttggtggaaaacattttttaagagtagcttttgattatggaaatgttgaaacgtccataagaatagaggggtggggtaatgagccctggagtgcccacagcaccgagtgagtggtccttcacaggaaacagcgcttggttcctgagcaggaatactcggttacttaatggctcgtgcctgcagcctcaccatagcaggcacgatctttctacgtcaaatcaaagtctccgtcgaatgcttcttacagttttgaacgagggaggtgatggtgggacggtcacgggtgttaagaattactgaattactgttgcgtttgagattcacgttccccctggtaggcatgatgttttagtgtatgtattttttctgaaatacaaaaaaaaaggtgttctgggagactttctgcggcttcagcctttcggaagatctcatgtggctctgcaggtctgataatgtcaccctctgttaattcagtaaccgaagggtgggggacccaggctgggctgctatctgccggcccgtggggctggcgtaacttccatcctgtgtgagccgcaacttggccacttgcatgcctcaaggactgtgggcttggtttgaggtctcatgtgcagaggaattgatagcactcggggctttgaaaatcacctactgacggcatggggctccaccacgtgctggccatgtgaccattccccctctgaacctcaatttcctcgtctgtaaaatgggtatagcgacagggcctcccttgtgaggtatgcagggcataggaaacttctaataaacgtcttccaggggtgcaagtgaggtattgagggaggggaacaggggacctaggagattcccaagtttgattcctggtctcttgggagcccccactgtgcctggggaaaccccgtgggaggggtttgcagggaaggaaatgtcactgggacaaggagagggagcggagaggaaaggactctccctacctggaagagaagggccttaggatggctccggccttgccagccgcccgaggtgggatcccaggccagggaagcctgccattcctcactgcgccgcttccaccgggaagagagcagagactgttcaggatcctcggatgtctggctgggaagcaggcgcggggcctgctggcctcctgcccagccatctggagggccaggcaggtcgggcactggtgctcactcagcctccctccgtgggagcccacagtccagcctcactagcagccagccgctgctctccctgcgaaggctgtggggctgtggcacgtcgccgggacgcctgggcctggggccagggactccacccagcacccctggggtggagcaggccttgacccacatccccgcccccaccatgctcccgctcctttggccctcacatttcagcctgggcccagtggtttcccagtaattctcctggctacgcaggaagccagttgggacagtgccagcgacccgccaccgccctccgacttaagtccatgcttgccgcctccttggctggccagccccctcctgctgccccacgggcactcagagcctctgctcccagctcttctggggaggcccagcagcctggtgagctatgaccccactggtggggccctgccatgttcccaagcagaccctgtgtgggctgggtgaggccctgcttcccagatccagctggagagagaaacaaaagtggattttaaaggggggggaaccccaccaaagagctgcatgtcgtgtcctcatttttcctggaagccgcctccagcaggacaaacaaatatattttcaaaggcgctaaagccagtgactcactccaaggaacgccctctcttacccctgggtccccacccctcccgtctgccgcagcagcccttcccacacccccctgggcttaattgctccaagtggggcggtgcccgccaggcccggccagtggggatggcaggcgcctgggagccgatcggctgccccgcaggaaagcccccctcggccaggtctcacgcccacccttctcgtcccgcaggttcatgcagcatcccaagaactttggcctgatcgcatcattcctggagaggaaggtgagtcgctgcccgccccataccccttcggtctccacctccgtgggcaactgcgtggactcagggtggaggccctccctccttgcccacaaggccctggcctgcctggccccttgctccagctgccatgctcccctcctccctccctcccttccttccatctgggagatagatcagtgcaggccccgccctggcctcctgggcccatggaggaggagcctcaggttgctgagcacctgggaatcccgagaaccccagggagagctgcacggccaggcttcctggagccccgtgtgcccgacgggtctcctgccagctcctcaaaggccacgtggagcgtccttgcaaactgggggtggattctggaagcactacgtgcctggcatcccagtgaagttttcgtaggcaggagtggcgtgcctcaaagggactggagggaccagcttttctaggtccctctgagggtcactgactgctttctgacacctctaatgccaaaccagacgtgtggcctgcaagtccccatcttctttggacaaacctttgtgtggacctgaggcctaaagcccactttgtgtcaagcccaggcccggagcagctccaggtggccggtagacacaaagtgtccccagagaatggtaaagccgttgttttgcacccacaaggctggttggactgtgcctggagaggctgcaggtgggagaaggtggctggatgaggctgcatgttggacgtggcccctgggccttcccccagcatcttggggtcagaggagaaaggctgccgtccgtgtgtcttaagcagcattcccctgaatcacgtttctcagagatggggacctgcccaccccagcttggtggacaccctgctcgggcttcctggttgtaggagggaggccaggaggatgaggcacttattttaaaggacagctgttcccagcgcctgcccctcatgagctgataaccgtagaaggagagagaccgagcagagtggggaaaaatctctccatgcctgaaaaaccagtgtggagaaacaagccctataaatagcccatcttctgagtgacgacgtctccctcagggagtggacggcacggcggactctaggttagggctccccaggatggaagcatttcagaaactggccatcgagcagtcctccttcaggatgaggggattagaagtctttgtgctggggagtaaacttcatgatgttctttggctgagaggcagcccaggacaaggcttcagtagagcttccagaggggtctggagcaggagctgccaacggagaggccggcggggacagtcaggtcttgacagtgagtgaggctgacgtctggctgggagccaggtggaccagccagtctgtgcccgtctgcgggggcagctgctgtccggagccgggctgccattgctgagcgcaggaaggagctctcttgaattgttaaaggagaagtcgggcacccacatcccctgaattgcaaatattggcatctgattataaaacgtctttctcgattgccatgtttgtgggctgggtttagcctggggccgcctgggagcccccctggcggtcgtacttggcaggaggctgccagctgggggctttctgttgagggcagtgagatttgaggcccagctcagaggcctcacagaatgcccattggaggtggggtcctggcttggcactggccagagcattgcagaaacattttacattgtaaggggaacggctgtgggcattggcaagctgggctccatgcccgcaagtgggggcatcgtggcatcactttctgaggctgccccttttactcgtcccatttggccggggttcatggagggctggttgctccggctttcagacccaatctacatggaaaagaccaaggcagagaaaagaaggaaacccaggaagaggcgcgtggggcgtggggcgtggggcggtcccgatgcacaaggcttggaagaggctattcaggacctcaaatatcagggaagagaaggctgaagccagggaaaagagaacccggacctatgtttggggaaggctttgagtttgcccggctgtgggctggagtccttgtttcccataagggctgggggtgacatggcgacgtcagcgctgtcattaaccatagcaacagcggtgactgtgataacaggaaagacttccatcatgtttgctctgggccaggcctcgtcccaagtactttacctatgtattaactgatctgatctttgtgataatcctgtgaagtatgtacaattagcattcccattttacagatgagaaaactgagacacagaggttaggtcatctgtccgaggtcacccagccggtacgtggaagaggcaggatatgagcccaggatgtgagctcctggctcctgccctgaatgcctgtgctgtaccctgctcagcgtcctctttctctgtcccacagacagtggctgagtgcgtcctctattactacctgactaagaagaatgagaactataagagcctggtgagacggagctatcggcgccgcggcaagagccaggtaagaggcaaggtgggggtgactgtccttgcaggctccctgcatgctcagcggccacttgcttggtggccagcaccccgcatggctggcggtaactgtctccatgagttgttgttgcttggccaccggcagtgtgagtgcaggctcccctccgtggtagcagcagatgtggggagaccccctctggggtgctcaccctgccaggctatctcgagcctcccgtagtggccaggaagatagctggggagaaacagccacgggcctcctcagcctgtgaaatcccagactcctgactgggtgacctgtgatctctgtgcgtaaaaaggctacattccaaaagtaagagcttcccaggatgacttggggtagttcacaaacttcatgtttaaaatgttaatggttgtgtgtgtttatcttaatacatacttgaaagaaaaaatagccagtacttcagctcgccgttttttcagacgccgttgcttgggatgagactgaaagattatttacgctagagcagaggctggcagactgggactctggggctaatccggcccaccatctgttcttgtgaataaagttttattggaacacagccatgcctgtttgtttacatattaccatggcagcgtccttgctgctctggtggagttgcatggttgtgaccaaaagtgtatggcgtacagggtctcaaatgtttactagctggcccttcatagaaaaagtttgctttttcctccgagttagaggaaaaggagttggtttgaaaaaatatccagtaaataatggtagagatgagaggctcagtggcacgcctttgaaagggggatcctgggcgctcggtgtttgggagaatttgttttgcatccgggctcttgaagcatcgtctcagagcagatgctgggagcaccacacagaggaggcgggtggaggcagtgggcactctggcagctgctggattggagtcggtcgaggcatttccttcctggggtcctcagtggctggggtgggggccgggtgagagtgacaaaggccaagaatagcacgagccgcgtggagcgtccttgcaaactgggggtggattctggaagcactacgtgcctggcatcccagtgaagttttcgtaggcaggagtggcatgcctcaaagggactggagggaccagcttttctaggtccctctgagggtcactgactgctttctgacacccctaatgccaagccagacgtgtggcctacaagtccccatcttctttggacaaacctttgtgtggacctgaggcctaaagcccactttgtgtcaagcccaggcccggagcagctccaggtggccggtagacacaaagtgtccccagagaatggtaaagccgttgttttgcacccacaaggctggttggactgtgcctggagaggctgcaggtgggagaaggtggctggtactccctatagtggcaccctctagcccctccccagagctgccccgccttccctttcccaggctgccagaggtcgagacccataaggtgttgagaccagccatcacgggttgggggcggggtcccagtgtctgccgtgaaacagccactttcctacagcctaagaaaactcccatgagggaaacgaggctgttgtcaggagcatgagccacccctcgccgcattcccaacatccagccacgatgcctggggctgaactcggtccttatccgcagggatcgtggaagggtggctgcgtttgtggagagggttttcttgtctagttttctgtagccagagttgaccagtctgcttgcccttctaacagatgtgtaaaaccaaggccgagtggcacagagcatgtattccaaagacgtagctatgttctatttttgtttttttgggatttgtttttttttttttttgagatggagtttcacaccgtcgcccaggtcagagtgcagtggcgcgatcccagctcactgcaacctctgcctcctgggttagagtgattctcatgcctcagcctcccaagtaggcggcattacaggtgcgtgccactgcatcctgctaattttttgtatttataatagagacagggtttcactatgttgcccaggctggtctcgaactcctgacctagatgatccacctgccttggcctcccaaagtgctgggattacaggcatgagccactgtgctcagccgctacggtgtttttgaaattgaagtgcattcaggaattttctagactgagaggcaaaaaggtaagtgccagtcagggagtatatagatgctgaggtatgagaggcagcagggagcggtggggattatgacaaaggaagggtggctaacggcctcaagaggtatttggaaaacatcatcaggcgtctgttgggcccctactgtatgctcattctcttgctggccttcccagttcccctcccatgacctgtttgggggcattgaggctgggcttgtggtgggagcccttcctggtagctgggctgggggctctgaagagcagaggcccatcccctccccctgtgtgagagccacatttgcacagagggaggtggggagaccatggtaatttaagaagggtggggggtgtcggtgcccggcatatcctgttgtagaggcctggcctgtactgtggtagagtgagtgtccagtagagtgagtgtccggcttgctcttcgtggagtgagtgtccggcctgctctccgtggagtgagtgtccggcctgctgtccgtggagtgagtgtccggcctgctgtccgtggagtgagtgtccggcctgctctgcgtggagtgagtgtccggcctgctctccgtggagtgagtgtctggtctgctctccgtggagtgactgtccggcctgctctccgtggagtgactgtccggcctgctctccgtggagtgagtgtccggcttgctctcaggagtgagtgtccggcttgctctgggcggagcgaatgtccagcttgctgactcatccattgattgagcatttattgtgtgcaggacatggggagcttcatgctggttgttcagagccattgtaaacaggtggcttcaagacagtgccgcgggtctccctgtgcggcgggtctatctgtgccacggggtctccctgggccacggggtctccctgtgccgcggggtctatctgtgctgcggggtctccctgtgccacgggtctatctgtgctgcggggactccctgtgccgcggggtctatctgtgccgcggggactccctgtgccgcgggttctatctgtgccgcggggactccctgtgtcgcgggtctccctgtgctgtggggtctccctgtgccacgggtctatctgtgccgcggggactccctgtgccgcggggtctatctgtgccgtggggactccctgtgccgcggggctctatctgtgccgcgggtctccctgtgccgcggggtctccctgtgccgccggtctccctgggaggtggcattggtggcacatccttgaagactccgtagaataaaaggccccaaagatgaggttgaggagcagccccacaggcggacagggatggggccctcaagtgcaaaggcagggagcatgagagacagcgcgtgtcttcaggaacagcagggggcctgagtctttggattcgtgggggtcccggtacctcccagggccttaaaggaacaaagaaagggagattatgtgaccctctttcttttgctcatttttgatgggtaaatagagatgtttttttttaccctgtgaaaaatagaagtgcaaactcgataaataacagctcacacttgccttcgtgtctggggagggagtagggagtggtgaggcctgtggctcactgcagagcttgggccccgtctcagctccagtggacgcttggccattggccctgaattgccaggtgttctgatctttgatgacgagctggaaatccagttttatgtgaaactgcctgattttaaatcttaggtcacattttttaaaaagggaaaaaacagctcaacactgtatatgccacacaactcttacttgctgttgaaatcacccccagccccaagtagaagacctctgggttagactacagtgagaccaggggaggagggcattagatgtctggggccaggctggggcaccggggaagccctagaatgttccatagcagggaggaaacatgcccctctttacaccggagatgtcctggtttagccgtggtatctgcggtgcctgggagttggtggggctttgctggtgagtttttatcccctgctgaagctgccgttccaggcaggggctcccaggatggggaaatgatgcttgtctgctctgcgtctctcagaaagatggcagaaagcaagccgggcaggaggtccctgtctgtctccagggctcgccccttcctcggatcagctgcgtttgctaaggaggtggtggcgtggcctgggccctgccaccccccacaggcctggttcacaaccacggggtaaacaggggttctcaagtgctaactctggggctgagagtcctctctgccccatggcagcaaggaaaatcagcggcagcttcaggctcagcctgtcttgttaagtggagatgcagtgactgccgccagctgagcgtctctgtctgtggctgtatttgtggagccactgacactgctgatcagtctgccccaggtgagggcacagcaggcctggggtgggcccagcaccgctgcttggaaggctgcggtgacggacgggaggtgcaggcagtggtggtctctgagtgcgccaaggctgtgagcacacagaacctgcagctccttaaggagggtggggaggtgaactgagaccactccccacccactaccccgctgcctcagcatggctggcacctgcaggctgggacaggcatctgggactcttggtgactgtgggctggggagccactgccctgtgctccaggcaatgcaggcacccagggtacctctgtgggccggttcttctttctgacctatcctggcagctcaggccttgtgatcagatgggaatccctggccatggagcacacgagcccctgcccagccccactcccctcacagctgccccaggacacttgtccatgcttctctctccctcataggtttctgagtgagcagacacagccccttccccctaccgtgacatgggccccctccccaggcaccacgggaagatggagaacccgggtcttcccagccagtgagcccacccaccctcaggggtagggtgcccactgccaggagatgctgtctgcctcttccccgatgtcgtctagtgggagggagctcaagctcccttctccgtgatgtttacctggagggcagcaggtcgggttctccctcccttcctgggccctctagttttggaagaagacttaggttatctcagccaatatgcattggaccccttgatggctggtgggggatgggacctgggagtccagtgagacatgggagccttgtcaaaattccaggggcacctggccctgctgtgtgatggggatgggtgctgctggccgctatggtggcgatggcgatgatggtgatgatgacggcgacagtgatggtgccggccaacagtcatgcagcactatcgccacacactgtgatgatttcaacctcactagtgttggggacaggtgtgtaattatccccactggccagatgagacagaggcacagggaggtgaggaagcttccaaggagcctgctgagtggcagactgagggttctagcctggcacatgcagcccggggagttggagggaggcccagccgtcccctcggcagcacactggccataaagccagccttctggaagccagccctgatccgccaggtaggacaggcctctcctgtggtctgtgcaggagccctgcgagggcaggcggcagaggggctcatgatgaggctccatgtcagtggggagtcggatgctggatgcggggaccccaggtgagccaggctggatctgtgctgtggagacaccctctgatatggggtgggtgggagtcctggggtggggggggctcagtaccccccgccaccacctgtgtctcttcccctgccatgtgtccctcagctcctggggacagcagctggccactgtctctttctctctcagtgcctccgccgttaccatatatgtctttggggagttgctgagggctcttcctcatctccctctctcccgccttgtctctcctccccatctctgtctcccgctctgcgtctcttgcgctctctcagcacccccactcccagtgcacagcccctctctcctgggttgctgtggaggctgctgtgggtggccgcagagaggctgtggtgcttgtggtcctggcgcggtgcccgtggctccaggccacatctctgctgaagacaggcacgagtggcctctctcatgtcaccaggacagaggccgctcgcaggggccttcctgcctcgtgtccccaagcttgctcgccccacagaccccccaggaggtgcccatcggatgcacagtatatgcatgttcatccgggggcatttattcagtgcctactgtatgccagggttgtcagactctaccttcagatgcgaatccgaccttaatccttccgaaaatagggtaaagggatcagccgcgcctggcccatctcaacaccccagactgccctgattccacgctgcagaggtggacacagggtaggacttccgaggtgtcggggagtgggcacgaccgcccctcccagggtcaacagcgcccacgtgcctcctgtgggtttcctgagttggggggtgcatggcccaggaccaaggacatgggtgcccctcctttcgccatttgtcaaggtgggattgaaatggaggctgtggtgggatcccgagggaggggaagcctgtgggctgggggtgagaagtgactccagggacactggaccgtgcactttccccggcagcgaggcttccgacttcctcagacaccactgaccacgctgggatggctgtagccagcatcctggggctgtgccctcctggagttccccctgtctgaggccaaggtctgctttgtgaggggacgtgtcccagtctgagtcctcagatgtgagtgcatgtcggaatcaccggaagggctggggaaacccagtcactgggccgcacccctcaccccacaataaggccgagatccaagactctgcatttccaaggagctcccaggcgttggtctaggacgctgctgagaacctcggtgctgggggtcagcccctgagcagggagcagggtggctgaaggggttgttaagcccgaggtgggctaccccacagcccagaccacccatgggagtacactcaagctggaacggcccttcccaggtgtttggggtgggcaacggcctccctggccagggcccaacttggatgaggcagctctgagctgagttattgtcagcgcgcctgacagccgatggcagccagccccttctagaagggaggtctggccagtccagcccaggaggcagcctgtgcatctgcatgtttgcaaagccacgcttcatagatgctgtggccacccgaatgcttaaccacagcccagcagcaagacgccagtgccaccgtgtcatctcaaggacacctgccctgtctgaagtgcttgcaccaggcccttctccgccctgtcaccccgacaccatgtgccctgtaccaaagcagtttgtgtgtcatttcgatggttacgtttctgaaacttggatggttataaagtggaatatgaaagtccttgattaaaagtgctggccatgggacgtctctggactcagacccgcgctgtgtgcggccgccttcactctggcccaccttggcatccatggcactggtgcttagccttgtggccggctggaggcgagggatgtgcatggctgtttagagtggtgggattgccttcttgtttaatggagggtgccatcctctttctggaagcttctctgtgttctgacacggggatgcaggcccgggcataggcttttggaatgctagcccctccacacccacccccatgagaccccacaggcctgagctttggcaagggagggccgagcccccacctcccggaacctggcccctgagatcggccgtgagcggcttttgagcctggaggctgggttgaggcccgagcatcctctcttgggctccgagccccatcaccaccaccctgaggtgaatcacggactgtggggcggtgcggggaacagctcaagcgctggcacagtggtttatagtccatgattcattgatggaagggccgcgttatcctagtgaattgcaaaaccagagcccaggaatgctggggcctgactgcagaccgttggggagcgaggatgtgaggctggctaggccaggtggcagggcccggcccctggtagccaatatggccttcccgcagcgatgggggttcatgtggccaagggggcctctctttctgcagagatgggacactgagacgggaacagcccgtcctgggctccagtcatccggcctgggtccaagaaggaagcccagggaggccgaggctccgcccccgactgctgccgtccactctccactgttccccatctctgtccctctgggtctgctctgcccaagcccctggctctgaatctcctgcatttttctaggtttctctctctctctctctctctgtgtgtgtatgcgcgcacacgggtggctacgtctgtttctcttcccatgtcttcctccctctttctatttctctgtgtctttatctctgtgtccacgtctcgtctgtttctctgcatgtgctttcccgtctctctctctttcccccatctaagtcttttaactctgtctctagctctctctctctctctccccttctctctctcccccatctctcctcttcctcctcccccgccccctcccctcctcaccctgtccctgggtctctcctctcacccttcctcctccaggtctctgctcctcccccacctttctccctttctctctcctccctcccactacagccccctgtcccctgcctcctccgtctgtcctctcccagctctttgcggagggactggtgaccttgttccccttgctgtggcactcggacagtttgcacagggaacagtatgaccgggaaggctgttccagggcaggagcagccaggcttggtccctggggaggggcagccgctgtgcggtgggtgttggtattcagggctagctgcctgccctaggtgctgaagtcacttgatggtggggaccggtggcagggcgggccagatcaccccaggctgtgtttcagctcccaggccgagggcttgtatcttgtttcaaacctgctgcctgcttggggctgggccaggatgggcccacagccttccggtggtgccgactttcccaggcctgccagaggaggtggctgggtcctctccagtcagggccagctgggctgggcaggattgggtgcagttttagggttgaagtgagcagatgtctctggtttcctgcccagctttgtgctaggtggggagacagttgggggctccccacgtcctgcagtcagggatgttgctcccagggaaggcagctggtgagtgggccggagcccagggatggagcagaccgggctgcaggttgaggaaaagaccaacatggcctttgcatgggccaggatgcagtgcaggggcgatcgcatcagagaggcagaaggaggtggaaaatgtgagcgctccccaggcagcagatcggtcaggatcgagggggcctgggggacatctcaagctgggctgctggagtcaggaagtagttcccagaacagcagccttggtgtctgtggcagctggaggcactgagggaggggccctggcaggctcacaggcggcaggttgtccctgggggatgggtggtgtttgagtctgttctgcagggatgtcattctaggtgattccctcgtggacaagacaaacaaggtcaccccggtgcggtggctcatgcctgtaatcccagcactttgggaggctgaggtaggtggatcgcttgagcccaggagttcaagaccagccagggcaacatggtgagaccccatctctacaaaaaaattaaaaaattagccgggtgaggtggcttgctgctgtggtccgagcttcttgggaggctgaggtggaagcactgcttgagcccagaaagtggaggctgcagtgagccgtgatcatgccactgtgcacctcagcctgggcaacagagcaagaccctgcgtccaaaaaaaagggcaaacaaggtccctggagctgacacccatggggaacttggaccatgtgcaagcctccaaaaaaaagggcaaacaaggtccctggagctgacacccatgggggacttggaccatgcgtaagtcaatcagcatggcaatttgagagagtgttgaagggcaaacatgtaagccagggtcaggaggccactgctgggcaggagggcagcttttatagggagctggccgcaaggcttctctgaggaggtgtcccttgggctcagacctgagtgataagaagggactggccaggcagaagtcgggggagcaccccaggccgtgggcacagcacgtgcaaaggccctgaagcaggaacatgcgggccatcttccaggagacaggtggtgggcatggggagagctgccctgagggaggtgggccagggccaggaatcctggcctcagagcaggagcagggactgtggatttgatgccgagttgcgggtcgggatctgaattaggatttacaacagagcctcggctggcacagcacacatctgtacaggcggaacaggcttccatgtgcgtgttaaatgttgctcacgttctgtcgacacgcatctttctgccgtagagtgctggtaaatgtttaacaaccagctttctgtagggggaagctgcgtttgtagcatgtgccggttgccatggtgtaaataaatcctctcaccgtgcccagtgccacgtgacaacgtgctgccgctgacttggaactggggaaagatgcccctagcaccaggctgtcttatcctgttctcaccctgtgcatggagttggcggaagtcacctccacggcacggatgacttcgtagctccatgtagccagatgatcaggaagcaatgcccttggagtgcttgtaaccttcgctttctttctttaaaaaaaatttattatttttttagagatggagtctcgctctgtcacccaggctagagtgcagtggtgcagttgaagctcgctgcagccttgatctcccaggtttaagctttcctcccaccttagcctcctgagtagctgggactacagggatgcaccacctaattaaaattagcaccaccagctaatttgtagtgacagggtctcactgtgttgcccaggctggtctgaactccgagccctagacaatcctcctgcctggccctcccaaagcactgagattacaagtgtgagttaccttgccaggccataatttctttaattgtaaggttaagtgtttccatttttaataatggccatgagctggtagccactggctccagcacgccttggtatatctttttttatttatttttgtttgagacagagtctcactctgtcacccaggctgcagtgcagtggcgcgatcttggctcactgcaagctccgcctcccgggttcacaccattctcctgcctcagcctcctgagtagctgggactacaggcgcccgccaccaagcccagctaattgtttgtatttttagtagagatggggtttcaccgtgttagccaggatggtctcgatttcctgacctcatgatccgccggcctcggcctcccaaagtgctgggattacaggcgtgagccaccgcgccccgccacgccttggtatatcttataaaaagacaacccttaaacgcactgagatggcctcccctgactgcattttccccagcaaggacaggagactgaatccgagggacagagagcaggtgttagggaagagctgccagcaacagggaaccctgttctgcctcggctctgacccctggccccactttccacaccaaccccaggctcctggaatccccatccctacactgccaggaggtggaaggtgtcatgaggatgcgccctctcaggggcacctggcacatggtagatgctcagtgaagtgtttgttgaatgagtgcatgagattgagccacagacggtgttgctgggttttgggaagttctcctgacacatttgtaaggacttagcatctgagaattaaatctcatcaacccctacgtgggtggtcgcagcaccttctcactggactgtctcctctcattcccggaatccaccgtcttccttcctgcgacctgctattggattgctctttaacatggggtgggtcatgtgactccctgcgacccctgcaccttttgagaaaggtccccgggggctcccaccgccctcagaatgcctcctgtatttctgagcatgggtgttagccctggccaggccctccagccatgccccaaagtgccacttggtaggcacaggggccattttcccattgccatgccgcagaggcctcctgctctgccaaagccccttccctcgccctgcatgtcagcacgccttgctgcctcatctgcatcatgaatgtgccttttgaatgtgtcctcgtcaccggcgcctccatctggcctgtctttgtcaacctaaatacaagctccatacagttgggggccacatctttctgtggctggtgtgccccttgggggttcaggttatgctggcggaaggaaagaatcaggcaatggcatcatttggtttaaatgggcatagggaggaggctgtgaacccccagcccagggcggaggtagggcacctggctgtaggaccttctaggaaatgctgtgtgaccttggatgagttacttaaactccctctgtctttgcattctcatccataaaactgggatgataccagttgttgggaggattcaaataacaggtaggaagtgattaggagaagaaggcctcatcaaatgtgctcagcgagcttttgctgtttttaattaagatatttttctgcatagcccccagtctggggcttctgcacaggcccagtcatgtgctgcttgtctggcaggctgagggttatgggttcagtgtccagatctgggggcaggtgtctcttggggctttgggccagtggctctggctaaccatagatccagtagggtttgtcacagagttgtactgtggtttggggggatgtttctgaccacgcacagggcacaaacccactgtcagcctgaccagtggcacatctgaaaggcagaggtagccctccaccacgagggcggggtcctttgagatagtggagctggcttctagttctttctgattctcctttcagtcccctcacgttgagggaatggtgcccacaggcgttttctgctgcacagagtcctttatgtgccttgtgagacaaggattcttgaaggcctcactcctcagtgggatctgaggccagccgtggcagcttctcctggcgcaggttagaaatgcagagtcccaggccccaccccagaccgactgagtgggaattggcaggggatgtgtgtgcacctgcaggtgtgggtaacactggcctggagcagagtgctctaacgaaagcccacaggccaaatccggcccaccacctgcttttgtaaataaagttttattggcacacagccgtgcccttttgttgatataagggccgctttcacaagacagtggcagaattgagaagggggttgacagagacggcatacttatcctctggcccttacagaaaacgtttgccagtccctggtaaagcactggttctcaaatctggctgcccatcgggataacctggaatttaacatacgaacgcctgggtctccgcccagagatttggatgtcattggtgtggggtgcggcctgggcatcaggacttcgcagggctccccacgagatctgagtgtgcagccaatgtcatgggaccttgagaaccatggcccccagtggcccgggaagcccagcaggtgcagttctgccgctctatggacaggcccaagacccagcagcccagcctcgccagtgtcggctgctgcacttgctgccctaaaacatagaaggctttgggggctgagccggctgccgggtccccccagctcctcagggggagttgtgagctgggacctccctctccctgcataatctcccagcagcgagtatgagcggccctcaatcagtccctcggcctcccgggtggccactgcgagaccctgcagatgttcatcattaaggctgccggggtctgtcccactggaaagcatattttaaggccagggctgctctgctattcctccttttcatcttcccccaccggactcactcagcgtgggctgcagggatgcctctcccacaggagatgttgaggccacaggaagtgaggagcctgtgcacagggccctaggccttggctgcagggtggcccagaaggtgctgtgctagtgggtgttgctgcacccactccaaccagagggtgagggtggaaggcacccctgccctgggggcttgttaacatgtcagggaagaggaggcggcaaggcttggtgccaggattgcactcggtgcctcagtttcctgttctgtaagatggacaggtgggtgggtaggggagaccatgtgggacggagccaggcacgtggtgccatgagcgatcgaatatggagacatagggggtgacgttccaggagcgagggggttgtgggcaggccctggcggggcttgtagagtctggagtgggaggcaggtagggataggtagatggggcgtgctggcaagtctgcagaacacaaactgtagatcctggctgggggttggctgagactctcagcgggggctctgggggcagcagggccccatcccccacactctgggccgtcagcctttgctccgagacctcgaagctttgcctctctgagcctgtttcctcctctgcagaatgtgaccagtgatcactgctctcctgtttctgaggctgggatagtgtttgcaaagcacttggcatggtgcaggggtgttactcgtggcgttttcatctccatcaggacttcagaggggccaggagccggcccatagaaaatggacagcacagtgctgggcacatagtcagctctcggggatctgtggggattttctcctctgtaccagcctcttcttccttggggcttttctgaggacttggaggagagctgcggtggggaaggctcgtagctcagggcctggcccagatgcatccctctcccaactggcccctgcctgcggcctgatgggtgtggagctgcatttactggccatgccggagcagacattagcctgattcgttggtccatgggtgaggccccagggggtcatggagcccccaccagcctaggtgcaggggctgatgggcagatgctctgggaaggaggctccgtggctgctgctcccatcgggagggacgccacagcccaggtggggacttcttggcacagacgtagctgaatgtggtctcaggagacaccaagcccgtgtgattcaaaagccccggccctgcccagactctggccctgggctgttgccagggacatctgacccggggagacggcatccatgccgggcagcccaggggccaaggctctctccccagccagccacatcactcctccctccccgggtccctacctctgcccacatcgggcaaatgtggacagaaaggatactgtgtaggaacaagccaaaaaaaccctccctgccccagcttccacctccaaaagaggcttcacctgccggctgtttaaacgttacgtttgagggttcgaggtcaggagagggagaacaggttgatcccaggatgccgggcacctgttggggaatcagcagcaacctgggggccggggggtctgttccaggtcgggcaactctgccccttcctggctcctcttacagaacatggtggcaagggattcctggggaaaagaggcagatgcaggcccgaggctctgccctggacctggcagcagcctcagggagcccacggttgcctgcagcagtcagacacttgctctgtttttctgccccatcctaaatgaaaagaggctggagagagcgttgtgtgcgggtcaggcacctgttcctggcaggaaggaaaggcaagagaagggagtctctctcacctccccgatccctcctcttccatctgcttggagttcttgctccctggtttgaaacattgccgtgactgtgcccctggtacacattaaaaggctttggggtttatttttatttcgcttggctcagagggatggaaagatggtctggtttggcagctgcctgcagggaggaccttggggtgtccaagaaaatcagtgtgtgctttaaaagaaatcaggcgggatgacaggaaatcgggaggcggtgccaggaggagctcacactccctcctctatctcggtgaggggaggggcggtaggcccagagtggctgggacaggtcggggaggcagatgacaggaagaggcccaagtaaggaggctggcttggctcccagcctctctgatctgctctgtaaaatgggcttgttctgtccccctggggtgctggcatgcgagggagaccaggcccaggcagcagagcagccacctccacgcaggcctggggccttcctgggctctggggaatcaggggcatccccccacctccccgttttacagactcggagaccgaggcttagagaggtggcctgagctctgtcgggggcagggcagggctggggcatcaggggtgtgtccccagcttcccagatgctcaggcacccctgccgaggctcaccagggcacctctctcaacccagatcacatctgcccctcttaaatatccgggccagatgcggatgtaagcatggtgaggattctctcatttcaacctcccagccctcagctgaggcacaggcatgctgaatacccccattgtcaaggcgaaggagtcggcacagagaggttaagaccctcatccaagctcacacagccactgtgtggaaagggcaggaattgaagccagcacttctgacaccaatgcttcctgcccctcaccccgactccgcctccccaggcccctagggcggcaagaccccaggccgtgcctctccccatctcatgccagtggggcctggcttcccggttgtttatgacctcttctgggtggactccacgggttttcctcctcctcccccagctcaggctgagcccaggtgcagagattcacctgttcacggttttcttccctccccactcccctctgccctcccccggggtctgacagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaagtaaggcagcctgctgtcccctgcagggcccggccgctgacccaacccgggtggcacacggttctgggggaccctttgtagagacgggtggggtgcccaccaattgcctgtgagcaggggggagggctttctgctcgtttgcccctgacagccccccttccggaagcccacccatcgccctactcctcctccctggctcccccctctcctccgccctcgctttctttctccaaccctctggagactttagagactgatagctcatttgagctccactcctgagctaataaatccaggcaatgactttggaactctctgcctccctgcttcctcccgctctttcctcctgaggcgccaggaagggggaaagggggatcagaggccctcctggaaggactaggtgtgcaggcggctgctgtcacctttagaatcatcgatggcagtgtgagttcttgcagatcaaggcacagcctcaccgcgggggccgtgacagcctcctgtgcctgccaggggctgcaggagtgcagccagctggagaaaggggggcggcacgacttagcgccaggtacctgtaatgggctcaggaatttggcttcagagaacatctggcttcctcaccccgtctcccagacgcttccagcaagggcctttcaggaagatgaatgggaaggcagaggtgatcaatctgagcctcccgcagtaaaactctccccagtcacttctgcgagagccccagctcgggtatcgaggttgtgagcacccccacacaccacagctaggcctgcaggctaggcctgcataaaaccagcaagagagtttcctcctgccaatgtctaagatgatgcccggcccttgataatactgaaggccaatgtattgcctcttatagagcccctctggaaatagctcctctgtggcgaataaaatggccctataaattgctgccagcccacgcccccatttagttcaccaaatagtcttgcagacagtatctctctatttggtgcataaaatggtcttgcagataaccaccagcccagaagaaagtagccttgcaggaaagctcccagtacctcccatttggggaataaaatagccagccaattaactacctgtccacatggccttattggtgaattaagttgatagcccaggttacacccccatcctttctttttcttttttttttttttgagacagggtcttgttctgtcacccaggctggagtgcagtggtataatcatggctcactgcagcctcgacctcccaggctcaagagatccccctaccttagcttcccaagtagctgggaccatcagcatatgccaccacgcctggctaattttctgatctttttcttttgtagagatggagtcttgctgtgttgcccaggctggtcttaaactcctgggctcaagcagtcctccaacttcggcctcccaaagtgctgagattacaggtgtgacccagcacacctggccgcaactcccttttgagaaatagcatggtgttgtcctgccagctgtactcccacttctggtgaacatggagcccctgcagacttgcccctggccaccctcacctcaggcctctccccctctttcctagcgtccgattagtgccatggctggcagccagtgcaaatccagctaaagaaacagtctcctccagtggctgtttgatttcccggctcgggtgaagccatcctatctcccctctctggcctgtagggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctgggtgagctgggggccagggatgcgggtggggaaggggctggagacacggcgggttgcgctcatatgaaagtttcgtgcaatttgagttaattggcaacagccaaggggttggtgtaagtcatggttggagtcaaatcccagcgctacctactggatgtgctgtgtggcccagcatgaattcctgaacctctctgtgcctcagggtcctcatgttctcagtgggaggaatcggtggttacctctaacgtggggggacagttgtagtcacttgctatgtgagaagcacctagaacagtgcctggggtgtaggaagagttcagtggcttcaaccacagtgatttcagagcagggagatgtcacaaaaaattcccagtgaccagttccggattttttggttgtcgtttttaaaacagaagatctggccacgcttggcccaggttcccatgaggtggctgttgttgggagccgagtaaccaccactccttcttagaatgtcatgggctctacttgtccccacccagcctctaccctggtaggcatctggttttgtaccttcacttccgtgggcctcagtttccccttctgttgagaagggtgttcatccctcactaccctcccagaaagtagaaaaaaatgagatgatgtgagtggcagttcccaagattcgccgcagggggcagcggtgtgcgtctgttgtctctactttgtttagctgttagggtccagccctccagccactgcgggaacccacccaggggcccaagcgctcaggccgaagccccgcctgccagggctcattctcagggtggagatgctgcttcatctcccacagacccccaccgtcccctggggtccgggtcatgcacctgtctcttcttctcgtgggatgtagtttggacctatttcataaatggcccactcgaagctcagagaggaaacgttccctctctaaaaatttcattgtagctggggttagaactcagccccattggccacagagcctatgcagctcctgcagatattttccagctgcctcttggtggcggtgtacttggaggcccagggtgaaagggctttcttcctgcctgatctctggggatagtcctctcggacccaaggctgatgctgggggctcagccgcagggtggaaaacacactcctaggccttccatgtctcttctggcactgggcaccctcagcacccctggcacccctggcttctgtaggcttcctctgggagtcctgtggggaggaatgggagcatcgatgaggtcccagagaggcccaggctgtggctgcagagatgggggaggctggggtggctctggcctgtcggggctgatggggctgcccatgggggtgggggccgtctcccctcttctgctggaaccttccgccactcctcagccagcctctgttggacacatactccccctggcgcagttccaggtgctgagtccatggagctgacgtccctcgcacccaccccactcatgggtcttaagcaactggaaaggaagggccagggctcacatccagaggagctcggcagacagacccaaaaatagtgccactgcagagatgcagccacctccagccaaccccaaggccaggttgtgtcccttcccagtaacaccagaagcccctccttgtcctggatgagtgggggtatgaacattccctctggagcagggcttctccgccatgggcgattttactcccccactaggggacgccaggcagtgtctgtgaacagttttgatggtcacaattggagtagggttgctggagtccagcgtgcagagtccagggttgctaagcatcctgccgtgatgggacagccccacagtaatagaagagctgggctccgagagggtcctcggtcagatgaggtcccggcccacctgaagcttgtgtcccactgtcgccacgtcaccaggtgacccctttcccaacagagtgcaggcagaggcagtcatggtcaaggcccttgactgcttcagtgtccccttctataaaatggggtgatcgcaggtgccccgacttcagcggcttgtgtggaggttggccccgaccaacggcacgtgggactgcccagcacagctccagcccagcataaaggctcagggagtcaggtgccacggtgggtactggctggggaggggcgtctgaaatgtggccttcccacggggttcagagccgtgcggtgacaccgtcaaggcctggtctactccctccctggctcaaaggagagaaaagggcagaaggcaaagtgcctcctctcccggctcctgccaataacctggcatcttcttttcagcctccatggagctgaatgagagttctcgctggacagaagaagaaatggaaacagccaagaaaggtgaggggtgtgtggcggctttaagccttgttggtttgcatccagggcgcctgaagctcacgtgctggggagggtgttgacacatttggccttgagccaggggctgtggtgaggcctctggtgaggttctggttctgggctgttctcaggtttgtcaccctggagcctcagttttaccttccagaaaatgggtctgtgcagctgcgctgtcaggcttgtctttgtgacttgagggcgcagctcagagagacacagcttgtgctgtgcatgtagtcagcgagtggcttctgggtgacctctgtggccagcacctctgggccttggggacagagcagtggcagcacacctgggtatctcgggacagtcagagcttgccggcggccatctcggtagagtcctggggtcagggagacctgcagggcgttcatccagcccttagagccccaaaggtcctatcctgggctcaagtgtgctggggctttggaaacctgtctcaggtttgagcaccccaatctgggtgacgggttctggagtggatggggacacccaggccgttggggacagtcgtgggagtggctcacacggcagggagccagcaggcattggtgctggcagcagaagccatcccgagcagatggccttgtgatgtgcagcaccgtgggggctggggtccagtgcctcctaagccggatcccctctcagctgtgctgtctcctggccaagatctttacttcccagcacagtgacctgcctctgggcctcggtttgcccgtctgttgagtgggagggtcgtctaggttggctgtgcggaatcagataaccctgtgtgagggcccatggtgggctgagtgggagcgaatctcctccctccctcggccgtgcctggcctggggcaggggctgtcggagctggcgcatcactggcagcactgctgaggccggggcagcacctggctcccacggcacgctcactctcggttatctaagaggtggggcctgctcctgtccccgcccatgtccctgtttgtgggcaaggagccaggaagcagaggccaaggagtgccacgggttccggagctggtgtgtggggctgggagcaggcccaggcccccactccccgtccctgtcccgtgcttggtcccgtggccctgctggagtcgaggctgtctgtgacgtgcggtttctttgtgcagaaagctccaggtcgtgacttatggagggaacaaaggccctttatagcaaacgctcttggcacataagggcaggtgtatctgagaacagcctggatcacggggctcctgggcccggccccgtcctccactgtagttgtggggggtgctgagggtccccacagccctgagaagacccccacagcccccgccctcaccccgggaccctgcccctcgccctcagagctcctccgggggcagtctgccctccgccccccaggctgaggtgaacctggacccagagagaccctcgcaccattcaggaaggagggcctgcctgccgctgcaggtcaggctctgtgtgtggtgagtgagaggcatgccagcggggcctgggcactgtatccagctggtagggcctgggcactgtatccagctggtagggcctggggctgctgtcagcccccagagaggccacattgttgtttctctgtctttaatgtccacttggtggtttctggcatgtatttcattataggctgcaaaagaagctttattgaaattgtgtgattcccgccgccttttatttaattttgagatgatacacatggcacgaagctcagcattctaaccactggaaagtgaacatctcagtggcatgaagtacatctgcattggtgtgcaaccctcaccactgcctagttccagaactttttctcaccccagatggaaatcccatacccattagcagtccctcccagggccccgccccagccctaccagcccctggcagccactaatgcactctctgtctctgtggattggcctgttctgggcgtttccaatgaatggaatcctacagtttgtggccttttgtgtctggctcctttctgggagcatgatggttctgaggttcatctgagtagctttgtacggctgaataatattccctcacctgcacggaccacattttgtcggtcgttcatctcttgggggatgtgtgggttgtttccatgtggctgttgtgaagagtgctgctgtgagcatttgtgtaaaattgtgtgagatttttaatcacaggtgagtccctgggatctcagcctgttggctgggagatttcccagagcacccacccatcggaggactccgcgtggacatccccaaacggtcagcccagggtcccaccgcctctccatcccttctcgtgtctcgtgttgtcactaccacctcctcaccggtgaccacccccgcccccaccgcccattgcctgagaactgggaagacagtgcctgccctctgtttgccttctggaagggcagatccggaggctgggaggacggctggggatgactcaccggcggagaggagcccgtgtcccaccatctcaaggttgggtcctcagtgatgacagtgagctcatcctgggtcctgcccatggagacggcagtgagcgtcccctgggggccgtgcacgcggaggccctgctcagtgacatttgtaataatgtcgtgagcagcagcatgttcgtctgccgtgaattacagcaatctggacaattactgctcagggtggctgctaatggctgtgtgttccaggcgatggcaggagggagcgggggtggggcggggagacaggtgctggcaggccccagcaactcctccatagggggtcggggtggagaagctaggaacgttctggagcccccgcccagaaaaccaagagttaggaaaagggactggagaagcggctattgctgaggcagatggtctctgcccatcctttacccatcatttcagcaacatagtgcctcactctctgtgtggcaggggcactcaggaatgagccagccccacccctccctcggggagcctgggcaggtaagcagccaggtttccccagggccttcggaccccagcctgcctgaagcctctggaagactttagtagcatggccctggaggatgagcagcagaggggccccattcctagggagaaaccaggtctcaaccccctggatgtttcagctgtgtgacctcaggcaagtcagccaacctctctgtgcctcagtttcttcatctgtacagtgggattcaaggagcgcccactgtatgtttcctgtggctgccataataaagggtcatgaactgggtggcttaaaataaatgtattctctcactgttctggaggccagaagtccaagttgaaggcatccaagaggctgcattccctccagaggctctggggaggagcctgccttgcctcccccagcccctggcgcctgcctgcagccttggcagtccctggctcatgaccacatccctccaggctctgcctttgtctttgtgtgcctttctccctgcgtgtctctgtccacattttcctcttcttacaaggacccaccccaatccagtatgaccccacgttgacttgatcacatctgcaaacatcctttttccaaataaggtcacattcataggttctggtggacacaaaatgttggggggatgctctccaacccagcacacccaccttcctggggttttggtgaaagtacacagaagagctgagggcagtgctgcccggggcataccgacctccccatcactttgtagctacaagcagctccttagccccctgaccttggcctggcccatctgtttcaccctcagttaccatcgttctctcagatgaggcagggatgctacctcccaggggcactttaaagacggagcgagccacataggaacagtccttggtatacagtaggcactcagaaatggcaggccgctagcttagggcgcagtctccagaccctgctccctaggtttgggtcccagctgtgcctcctgcagagtctgaccctgagcaggtacctacactttggggcctcggcccccgccacctctgtcttcgccccggcgatgggggtcggaggtaagtcacctgccaagcaaatgtacagtgacaactggaggaacttccatggtgctgggggccaccagtcagagggctaccccgaggaaggggccgacacccagagcacgaaataatagtgaatatcacccagtaacaccgtggagcccatcctgcgtgctgggcactgctggaagctttgtgtgtatgaagtcactttatctctaccaacctgactaggaggcaggtgctgttaatacttctgttattcaaatgaggaaaccgaggcctagagaggcttagtgagcagcctagggtcacacagctgtgaagtggtagagctgggatttgaacccaggcactctacttgcagagtaggaatggggttggcatgagagctgaacaggttagtccatgggccaacctgttgaccaggtaacaaaggcaggacaggcatgtgcaaaggccccatggcaggggcagtgtggccccatgagaagtggttgaatcccagaaggtagaggggccaccgggagcctggccttgccagcatgggatggagtgtagctattactctagagcgtgggaggccactggggaggggctggggacatgatggccatagggtttctggtgggcaagtgagcaacctcccttcttgtgtgcatgcggctgtggctgcctgccctggggcttgtgctgcctgaggaccgagaatgttcaggaggcagcttccccaggaaccgggcagctccggggagctggccgcctgccctcgggcccagcgccaagtggggaaggaggggcagggcaggagcagggctgggatgagggactcggttcccctgggaaaggtcagcctggcctggcttggaagcctgacccagctgtgcgagaggcccgaggctctgctggcagctcctccaggccccagccctcttctctggcgggcagagaacctgctgtggagggggttgggaggctcccggtcacaccattgtcacaccattctagaccgggagttggctctggcccgcctccgggctgccagtccttcccaatctccagggagcggccaacagtgggaggatgtgcaagaccaggccctggtggctcccagtaagcccgggcagaccccagaggcctcccccaggactccagctgccttgtctagtggccttgccacttctcacaggagcgaggcaggaaccacccattgctgtgcacatgggctggcctgacgggcttttatagatgaagcgtctaaggcatgggaaggggaggggtgagcccccagcctggagcctggagagcaggacctcctccactacatgtccactgggaaagccttgggctgtgcccaccatgggccccccaaaagaggagcgcctgtgtgctctgccgcacaaagctgccagagcttacagtggggtgggcgggccggtaggcagtgctgctgctcctgggtttgggtctgcccggctacttcctggtgcagctgtccgtcagggcccagcaggaggcgacactcgagctgtgtgactcaggaggggtggtataccaggcagggacggtgcggtgcctcggggctcgcgtccaaggagactgtcaccacgtgtggtctggagagagaccactagggagggtgcatgtctggggctggttggcctcccggccggatatgtgagaaacagtctgttgtgatggtttggagggaggaaaaaattggggtttctgcaggaacttggggtacagccagacacaggggcagggtctggaccacactcttgctcctgtcagcacccttgaagatgaaatcaggcatcaacaagccccccttccctcctaggggagacccatgaatccgcatccacatggctcctgactcagggaaggagcacctggcggtcgatgcggtagtaatgatgcctgtcgtcacgtggcgtggctggtgctcacgaacaaggcaggccctccacacgcgtgtgtacacacgcacgcatacacacgacttctgctttgcacaggagaagaccaaggccagagggagagccagtgctcacccagcccactgcggtggacacagggcatggggtggtctgtctgaccccccaggctggcttccaactttgctctgctctgtaggaaaacgtgacattgaaaggtgtaacgtggcacttccggaaatggtaggcgagacagcgccaggtcgtatgcaggtgactttatttcatcttaatgagtctgggtttttttgagagctgggagaagacgtagctttttcacatcgtacctatgatttacgggtataattgctgatgcggaggctaaggcagatagcgaggctgatttttgaaagagtagatggagagaaaagagtggggaggtgcaagtccaggtgtgatgttatccagccaacatcctgataggatttcaggatggcaggagttcgggaagtcctgacaagacacgcaggagtgcccggcctgtcaagggtgtcaatgcggaggcaccgtccctgtggaaccccccccccgccagggcttggggtttctgaaatgaggaagtggcatgactcaggcccaagacggctgggttcttttcctcccaactttgatagggttttaggcagagcatgctgagtttctcggggaaaatggcaggtggggggcggtggtcgatgcacccctctggcaggcagcctgtgagtcttcatggaaggggtgggaaacgtcaaggctggaggtgactggctggggtggggagagcgagtgtgtttccagggttgggggctgacttccagagaaaacagctgcaacatccccagatgcaggtgggcggtggtgtggtcccctcggagtcctagctgtggatgcaggtttgcagacccttggagaaaagcagcttggaggcatctgagcggcagcacaggcctccctgagggccagagcacctgagccgaggaggctgagtcctggcccccacaagaacagctcgtcatgggcccgcggatggcatgtgggacgctgccccatgggtgcccagaggaggattagcccagcggggccccaagcacccactcccgtggccgccgggcccctgcgcctggctctccactcggcgtctgtgactcagacctcctggctggacttcctgtcttggtcaatttcacttcctagttcctgcctcctgactcttcagaacgaaactccttccttagaaattagaagtggggtcggggaatccagaccacagggcatggtggcagaatctgccatctccgccctggcacagagtgttgggggcgtgtgcctggatgtcaagggggataccccagcctcttttgggagggttcggggccccctgcagagctaaacgcacagccccctcttcctttgcaagctccttaccagggacccagacgggtggcagagatgcccagggtgctcagcaggccccggacacctgccgatgagcagtgggacgagggagctaatttcagaggcggtgaaagctatgaagatgatcaaaccctgggatggcagggcgacgggggggggtcactttggaggggcgggcaaggaaggcttctctgaggagccatcacttgagccaagaccagagggaagacaaggcacatctgtgagaaaacccgtggaggcagcaggagcagctggtgcaaaggccctggggcacacacgagtgacccagagagaggctgggcgggttcatggagctggctcctaagggtcacctgggccgtgctagggcctttggattttattccaagagcttcatgtggtcactggaagattttaagcagaggagtgatttcacggggttggcatccttaaaagtgcactgagacctcccctgcagagggcagagggcaggactcaggtggagaggcccagatccctgatgtggttgaggtttgttgccctcccctggcatcgtgccccaggacgagggctgggggtgcagggacattccagagacgccttctgctccccagatttttagggggcaggatggaagggctgggagttaaagggaaaagcaggttaatgatcccagagtcagggaagtcggtcgtgacctgaatctaggatccaaagttcagctcagttaactttcaaccttctgggtggctccccggcatttcccacagtgttccttcacggctgcaggggctctcggaggaggacgaaaggggcagctgtggtcccgagacccccccagcagcagagggctctttggggaccccaaatccccaaacccttccccctcccctaaatggttggcggtctcatgtgcaccctgcaaaggctcctcaaatcccgggatccctccggaatgcgaggctagccctgcccacccacagtccccgacagagggctcggtcagcctcggcagcatcaggccaggcagggggcagagctcaggtggaactgacacggagggtggggggacgggcggcgggggatgatggcggaagaagctgtttgctccctgtctgccgggggtggagaagctctgtttttctggaaccctcatctgttcttaccactgctgacgccgccaccgccgcggatggggagagagggagggggagccagtgccaagttggcccgccccttgtgaacctgggcctctgccacgctcccccgcccgcctgcccgcccgccgcgagcctccgtctggaggtcacattcagtcctgccgcgtctcgctgggtcaggcagcaagaagatcagagctgagcccggctgcgggggacacggctgccctgctgggcctgggtccttggattttgcccggcccgggggtctgtgggctctggccggcattgctcgctgagcgtccgcactgggcacattggtgctggaggagctcggcacgctgcgccccggtgatacctggcccaggggcatcccacacgcaccactgacaacttcccgccacccaccaccctcggggaagggcacctcgcgcgcccacagcggctgggggacggcgtcagaggtggcaccgcccgctgaaggagccccggccaccaccggcaggcggacttgggagagctgcctcccggccggccttttgaaccaagctcggcccgcgggggcctttcctcccttgttcccttcctnccttngttccttccttccttaangggggacggaaaaagaatggaggctaaactgaacccccaaaaaaacccaaccagaagcccttaaaaagccccccgggggcgcgcccaactggcgggcccaaattggccccggccctggggggattttccccccccccttgtgttccgggaaaaattggcgccgggggggagaccccaaagaagaagggttggggttgtggggcctccgggagggggggagggaaatcccgttctccgccacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgctgagcgtccgcactgggcacattggtgctggaggagctcggcacgctgcgccccggtgatacctggcccaggggcatcccacacgcaccactgacaacttcccgccacccaccaccctcggggaagggcacctcgcgcgcccacagcatgggaaaaaggagaagaaaaaaaagaggggggggagggnnngggggggggagggggggggaagagggagtaanaaaaagccctaaagaaaaaaggaaagaccacagagaaaatnntaaaaagaaaactccctccctccctccctccctccctcaccgtgggacggagaaggatgtgaggctgagctgagccgccagcagacgccaaccagcagcctcgcagagccgaccgcggccgcccagcctgccggcccacttcggcccgctccctggggcatcttcccagccctatgtttccggaaaacttggccgagggggagacgcgaatgagaggatgtgagtgagtggtcctggggaggggatgggggactgcgggtgcagggacagggaccgcaacgtggccatctgggatttgaggctgggcagctggggagtcggagttctgggcccctggagtggatgggggtcccagcccatcctttcccccatgccctctcctctctctccctgctgggctgaagctctcctggaagcaggggtgggacctggatctgtgcctgggaaggtctgtgatgctgtgtgcacagggggtctctccaagtggacgggggcttcaagctgggtctggcggggtggtctccaaggcacggtagggtagaaagtctttctctccgtgcctggcagcctctgcctgggcttcccagaacaggaaccagaggaagccagtgccagcctgcccctaccccgcagccctggccggcactaatgggacacccactctggctcctcacacggcagttaaggaaactgaggccggagagcagaagggctggccaagactgctagcgagctctggccaggcgcctggatgactctgcccagctcctttgggagccgtatgttttcaggaagggctgggtgacccccacccccacctccatcccctctcctctgccctcaacccactcccactgcccccatgatcggagttaattagggtccccagcccccagccaggctcctagctacctccttatttattgactgagtttggaaatgtcaacctccccagtgttgttgggccaccctcaccccaccccctgagctctccatgcccaccccacccagcaggcccagatgggagacccgccccctctcgccctctcccacccgggtgccgggtctgtgatccctctggcccggtgtgtttgcctgggctctcttggccccggctggggaaatataaataaacgcgcggccctgtccgccaggttctggaagtggcagctgctgctggcgcgggcggagggaaaggtcaggggccgggtgccacttgatcccacgccccggccctccccttctgcgcctgtccttgaggaaccctgaggagcgggctgtgaggccacgtggctcccagggccacggcaggcgaacaggtggcctgtcagtcagtgccacccccacgccacgggggccagaggacccggagggcaggaagtctggggccccacgcccgcgttgccccccttggctggtcctctaagcttgggtgagttggcgggaccctctgaaccgagatttccccctcctggggatgggaaaatggtcacagccatgacagcaaggatgagacggaaccaagtctttgaagggctttgcaaactctgtgtgtcagttagccgtgccacgggctgatgtgttgatgtttctgctgctgttgttttatttgcattagagccttgtgtgtagcaggcaggcagccagcacgtgggtgggtgggtgggtggatgaatgaatgaatgaatgaatgaatgaatgaatgaaaataccaacacagacggctgcccctcagctccccaacctctgaacaattttagctggagcttggcttgcagcttgattttattcaaggaaaatggttaaaaccttcattatgggaaatccttcattaaagtccttacaagtggagctccagctcagagaggctgccatgtcccgagctacgtgattcagccttggggcctgctgccctggaggggcaccctcttgccgcacagacccctaggtcaggagcactccctgtctctcccacagccctgggaaagtgggcaggccctacctgcatggactggctgggccacacaaggtcacgccgctggagacacaggcataaatatagagctgcctggcctgtgcctgtgtgtgccgcagctcgccgggcagacaggccgagaccgggggcttggcttcccaggcactgcctccggtgcagcaggggctgtgtttctgccgagcctggtgtttgtggccttgaaactagaacctggggggcggcatgctctggttctggcctgagacctagtgatggagggagctttttctgccgattcctggagggtctcttcccacagcaggaggtctgtgaggctgagagaacctcctggttgtgcgggttggggtttgggagcaaattccagctgcgcaaccaagcctggtgggccccgagtcctgagtgggcctttaggtgcccttagggagtttgggccctggaggtgccccagttaacctgggcctggaggctcctggccccagctcatccccaccctgacttccaccctcccatcccctgctcaccacgtcccttcctttcgctgggccggtgtggccggaaaacaacccgtctcccgaggcctcgcctgcagctgtgagcgagtgtcagggctgggtcacgtaggccaggccctccgcccagcaggagaggtggggcctgggcagaggctgtgcgttctggatattcacagccctccgcccccagactcccgcgcagtggcctcggtgggacttcacctgtcgcttttggctcctccagcccaggcctttcccatgcatcctggcctggagtcaagtgactgagaaaccagaccccagaggccaggactgccaccctctagtaccttccccgctaggggacacgtggcccatcactgtctcttcttccagaggtcctgggcctgagcagggagccccaggctgggtttctgctccaggcccgtttgccgcccaggccatggatgcaggccccctctgcgtgccgggcctggcctcttctcactgccctcctctcctgagacaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggtgagcccccagtcacgctgcaccgcgcctctgggaagctgggagaggagcccagactgcctcaggagatgtctctgcaccccaggaggcatgggccagggaggggctattatgccgccttgttagaactcagcttctgggggttcaagcccgggagtaccccgagatggctgcaggcggcaatgctgctatgagtgtccctgccttggagacgggccgggccaggctgccctccacccccaccctgcaccccactcctctcagacagacacctctgggggccctcagccctgtctcacggtgtgggggaaggagcgcggtggaccagactgactcagccaggaattcgggctgtcagcgcgttggaatgaggacccggaggcaaatgggtcctgagcgagtggctcccctgccccatttgacctcacagctttagggctgccgtggttggggagggacaggtctgggggggcgggggcggacgtctcagccccagcatcctggagggcttgaggcaggccacgggaggctgagacccttccctcctccacaagcacagaaggtgcaggctcgcctcgccagcgtgtaaatggcctctgaggagcagccgcttcttccacagctgtttctgggaattgaggagcattttggggagacctctgctgccttccctctctccttcccttcctcctccttcccttcctccctcctttctccctctttgacacacttgccaagcattgtcccctttttggagctggggaaactgaggcttagccaggctcatgtgcgactgaattgcgatatgcacccacagttatgagatcagcacccacgctcttcatcgctaggctgcgtgtttcctcatcgatacagaagcactgagggaggggttgcatagctcccctcccccaggactactcctccccccgccactcccaaaccatgacatcgggctgccttgtgcctgggtgtaaagtgtgtgcagtgggttccgggcaggccatgctgaattgctccctcagtgcaacctgctgaggcccagagagggtgagcaggctgtgaggtcacacagcctgcagtgggaggaccaggtatagcctccccctgtttgaactccgcccaagcactgtgcagaatttaaggacatccttccaccctcccgagtgggttcttagtgagtcatgtgtgcgcgcggccgctggtggctccgggaccgaggggccacggtcccacggccctgtggtcagggctgagatccaccctctggcctcagggaggcccctccccatcacttccagttaagcagtgccccgcgtgccctccacattggcccctgggatttgtccccagagctcagggcttcaggcagcgccttttccttctggatgcttcgggccttctggttgggtgtggaggaaggcaccgcatctggctgaatgtgcagaaccccgtccctaacacttgctgaagtcccttgtggcaaagagggcctgagccagagcagcctgggggcgcagaagggggcctgggccgggggatgttgtgggccattgattctgtcagccaggtcaggagtctgaggtggttcatccaggatgacttgggggcagggctttggccctgagcatctccccaggaacaaaaagggcctcctgctttctccccagctgtcctttcactttctctctcctccccccgcctcccctctctggggctccctccgcctgtccccctcaccccacgaccatggacgtctccccccgctgcagcctgctgccacacagcctggctttccaggcttccgcagggtgtggccccactgtacccctagagactccaaaacctgagagtggcttggaggaccagagaccccagcacggtgaaccatcccattaggcccagggcgagactggggtcaaggcccagcttgtggatttgggcacccctgtgaccttgggcagtgaattcagccttctaagcctcagtttccccatctgtaaggtaggagaataacagttgttatccaagaggtcctatgaggagtgaacgagtgattacctgtgaggtccttagtgcctgccagaggggcagcgctccgggagggcgacgtgccctagttactcttactgctgtggttattgttattttatctggatgccatctacccccttctcagggccacctgaggccccctctttttttttttttgagttggaaggttttattagactaggagatttgtgggaggtatgagcactgggccaaggtggcacgggccatgcttaaggcaccctgttgagtgtggtgaccaccagtgaagccgctggcgtggacgaacatgcagccagagatcccactgacgagggcgcctcttgaacggtgcgtgcaggcacagccacagtgtgctatgggttgggagcagggactgggcccaggagagctgagtttgaacgtaggctctgccacctactagctgtgtggccttggggaagtgacctgtgctctctgtgcctcagtttccccatctgtgaaatggggacaataatggaacccacttcaaagggctgttatgggaatacactgggtggctgcctgcagagtgctgggaatgcggcctagtatgccccagacactctgctagtgagagctgtgatggtgctggtggtggcacactcacgattgattgattcattcattcattcatccattcattcaaagaggcatcccagaaggatggtgcagagcagggctttggagctggtggctttgtaccccagctctgccgcttagtgactgggtccaaggatactgggcttcacctctccgtgcttcagtttccacctctgtaaaatggggataagaatgggacccagtcgtagggctgttgaagaacaagtgtgtttctttttgtaaagggtggtgcctggtccttggtcagccctcaataagcattcagtattatcctcactgtccattcagcagccccatattcagcgcctgctgtatcccagggaagcaatggcagctgccctgagggcagagacatggatggggttttcctgctgggctgtggagctaacacttcgttagtggaccgtggagggagtgggggctgcattgaaggattctgagctgagacacagcccccatccagggctggactcaaagtgggtcgtcctagtgtcgatgaaagtgattctgatccgaatgacacagtcaaagctgataaagaaggtggcccttctgtcccctgacgctgaagactctggaggcgtggacaggaggggaccccgagatccaggttgggacctggatgagaatgagtgatttgggagtgtggggttggttctcgctcctggccgaccttgaaggagcaccctcatatcgcgggctgcagagaaagcggagcagatgcagggacccactacaggaagtggggctcaggccaggccatccgtcttgacagtagccgttcttggtgtagtggtgagctccccatcgctgcagtaagcaagcaggtctcaccaggagaggtgccgctgaacctggtgacctccacctcctgcccctcccctgtgcctttcagtcccagggaggagggcatatcccagtgaatcctaacgcagtatcagccacctctggctgctggcccagccctgtctggagtacaggaagacatgtcacccttggccagagaaggaaggagtggggaagcagagggtcagtgggtgtcccctcccgccttgcactaggtctggcccgagtgtggccgcaggcgacgtcagcaggaagcaggatccggcggccgggcgggcggggcatgtcccggagttatgtaacacttggcatcagtgtcttctacgaggtttccctccccctccttatggccgaaggttacccttttctcccatctgtgaattcaggcccctggggctcggcttccacgttcctcagtctctgtccgcctcagccttggcccagccccgccttgttttctgctgttaatctcttctacctgaggctgcacaggcctgcagagagatggtccagccacgaaatgtttgaagctggcctgcattcaaatctgagctcctcaactcatgagctgtgtggtcttgggcaagtgtctttgcctctctgagccattgtcactgtctatcaggttcattcatctaaagacatagttacagagcgtctgttctgtgctagacactgttccaggtatggtgggaatacagcagagaacaaagatcccagcccttgaggagctggtgcgagagacaggttcacacactcaatttcagaatggagtctgaagatgctatgagaagaatgtagtagaaagtgattgatggtgggggtgggagggatgagctaatgatggagtgatcagggaagacctctctgatgtctgagctaaggcccgaaggaggtgaggaagtgagttatgcagatatctaggggaagggtgtccaggcaggggaacagccagtgtagaggccctgtggctggggcagcgagcagggagggcagtgtgtttgtagcacagtctctgaggaggggagaggggagagcagcttggagaggcaggcagggtccagggctggatcacacagggccatatggatagggggaggacttggggattgtatccaggtgttggagagtttgaagcagggggtggcatgcgctgatttgcagagcagctgtgcaggtccagtaaattaataccagaaaccgcttggcgcatagtaggtgcttaataaacgtcaggcataatgattaatgccatcactagcatctcctattctacacacacctcctgatcccacagtgccggaccatgtgtgtaaggattaactgtaactcctgggactctctctgagacccagctttgtggggattcagggtgttggcaccatccccgtccactgcctcagagaccccacgccgccccccgcagagacaccttgcactccaggatgctgggcgccaccaccaggccgacaggagacccctgttccctgcgagactctgagcatctcccatgtcccagccaccgcccgggcagctcagggcacccagccctgagtctttcctgagcctctgtctgccaaaaatagattcgggaagcagggggagccctcggccgcagccgcagaacccacatgccaccactttctcaggccgccacaggctcgaactctcctgggagaggctcaggattcggggcagggctgggactgggcccaggacgtgtgcggggttgcagagctgggcatccctgtgggccctgtgggcactggcaggggcagggctgtggccctctggccgactgttggtgtcggaaactgtgactaacggacgagcagtcgtttcccttttcctccctgcgttccaaggggctgtgctcagaggaaccctgtttgctcaggaagaaggcaggacaggaagtgatcccactccctgcctgtggctggggcttggagcccgagaccccctctcctcccctccatgaggcccagctccagcctggccacggtgaagggctggggtgggcggggcccacctggcatttgcccgagagcaggctgtgtggtctggacgtcagcagctttttcttggaatccgggtgcaccagcgcagagggatgtgtgattccccctggctgccgcaaggaagtaccacagaccggtggcttcaaacaacagagatgtattctcttccaattctggaggctagacgtctggaaccaaagcgtccacagggctgtgctcacattcaaggctgcaggggagcctcttccgtcttccagcgactgctggcagttcgtgacattctttggcttgtagctgcatctctccacatgtgcctccactgccacagggccttcgtgtccctgaatccgtgtttcccttttcttccaaggctgtcagtcctgttggatttagggcccaccccactccagtgtggcatcatcttaactaatgacatatgcaggatcccgtttctaaataaggtctgaggttccgggttgatgtgaactttgagggacaccattcaacccagtacagggctcttggctgagagctgcgggcacctccaggtgtggcggagggcccacctctttctcagcaaccccagagggatcaggctgccgcccccccgtcacaccaggctgtggtgggcaccccccagtgtctttccagtccccctgggagtccccagtcacttcgagatgctgcctccacgatgcccctgctctctgctgtctatgcgttcaagcccacgaaggctggcctttcacagttgctcagcaagtcagtcaacaaacgctttctgagcctctgcctggctcagcgtggggacaaagagacacccaccccagtgagctaccaagacgagtggtttgatgatggtgcctaagctgggggaagaagagtgggctctgtgtgtgaggagctggggttcccaggagcagggtgcggtgcggggaaagtggaggcccgacgatgagggcttctttccattcctggacacacccggcatgttccccacactggggcctttgcacctgtgactccccgcacctgccactctcgtccagagcctggcctggcccattccctccgccgtcaaatcttggctcaaatgtcacttccttgcagaagctcttccagactgttctgtccagaggagcccctgccttgtgctccttgtcccatcctgtttcacccacgcgaccctctgatcctctgagtgctgcttctgtgtgaggagcacgttgccagtctccccagcggcagggcagcctccaagggcaggaccttgtctaccccgtgccttgtgtccccacagccctggtatgcagagctgggcacacagtaggtgttctgtaaaggttcagggaatgaaacgcgagcttcccaggctggcctgttcccccagggacaggtgagacttgcatagcaaggaaaagcttcctgtgttcattcactccacgtgtgccgatgaagctgacagggtgtccccaggaggcgtggtcactcgctctgactaggagactcctgggcaatgtcaggcaggttctctcgtgctcaggaaggatgtcagggtggctgaggggccagcctgtacccagagtgtatctggggctcaatggaagaataaagcccccggtaaaaataaaccctggcacgcttggctgccgaggtggggtgtgagggggacggtcaccctcattgctacatggccgggatcactgccctttgcacctgcggcgaggccccaggcatggggagtccccgagctgacagcccaggccccagtcctgatctgctgcttccctgtgccccaggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaaggtgagggctggcgcggcttggaggtggctggcagctgtgggtccgagctctgagggagggcatagcgggaactgatcccggcagcctcctctcccctgagtcatctgggtcctccttagaaggggcctcgactccctggaaggtgcgggcctgacttgccagaaactcaccagtaatgggcacaaggatgaaggccataacaatactgagaataatcagcttctctgggagccccaagcctcgctcagctcttctgatgcccatgagtccagtcttatgcttgggtgaccagacgtccaggccagccctgtgggtgcctgctgtctttcaccccatccgatgtcacagtttagaaaaaaatttactttggaaaagtttttttttgtttttttttttttcagacggagtcttgctctgtcgcccaggctggagtgcagtgacgtgatcacggcccagtgtaacctctgcctctcgggttcaagcaattctcctgcctcagcctcctgagtagctgggattagaggtgcccgccgccacacccggctaatttttgtatttttagcagagatggggtttcgccatgttggtcaggctggtctcaaactcctgacctcaggtgatctgcccaccttggcctcccaaagtgctggaattacaggtgtgagtcaccacgtcaggcccgaaaattgttttttgaccagaactcttttacaaggtaaccagcataaatagaacctatctgtcagtcggtaaatattgtacaagttatatagttattttcagtgtctccttttattcccaagtgtccctatttgagtgataaataattcagtccccttctttggtgtccccgttttctctatggggaaaccgaggctcaggcacttaaaggcctgggcccaggcgccccaggtaccacggagtgtgttgtttgcaccagctgtagactagacaaatgccccaccaggtgagtgctgctgaagagagggcgtaaagccatcgtgtgcatggtgctggtgggtccccccgagtcccctcaaatgcaggactgtgaccacatgagctgtgtgttgtccagggctccggataacacacggctcaactttgttatcagtgtgtatagacccgggaactgaacacgggctgccgacacctggccccgcactctcggtcacgagtgcatccaccttcgacccccaccctgtgcctctttttccctgtcaaaggggaagctgggggtctagactgctccccctgtggcgtgaccgaaggcccctggaggacctcagcccttctctgctgagtgtccctgactctcctttctgactctctgaaggagaaacaagcagcccggcggagcccaagtccttggtgaattcaaccctccttcctcctgccccgtctggggtccttcttgttgttcctgttgtccctccctctctgcctttgaacgccctggcttctccctggcagaaggtgcaagtcacctcctggttccataagcccagcctgcagataaatccaggctcctccagcccgcagggtttcaccagcccgaatccccgcttcccgctggaaatgggcaactgggcccttgggtgactcatctcaagttgggggcgggtcagggacactgagtctggcctccccaccagctttgggtctctctgacccaagttgaccagaagcctggctagtgtctgatggaaggaaggcctgggccacgagtcccttgggtcgtcccattttgggtcctgggtctgtagccaggagaagaccccgggagcagaaacccagtcccctctgtaaatatccctccagtgtctgaatgggcgggatgcaggcttggtgggagcatttcaggaagccaagccatggccacacattaaaaccggagcagacgccacccaggactgtgtggcaacgacccccgcatcgcttgcagagcttacgtagccccgtagggacggggaggggcatgctctgctgggtgggggaggagggagggctgaggtggctggagctgaggcttctgtgacagtggtggtcttccgtggctgctctgagagatcagggacggcaggtgagaggccctgattaagcctcctggtgcccagggtgttagcccatcttaaggacgaggagcccaggggagaggagaacccctcccatggggtgtcccagcacatagccggtaggctcggggtctgccggcccagccagcgcacgctgcgtgacctgtctcttgtgctcaggatggggaggtgaggcaggtgctgggttggagcctgaggttgccctgcctgaatctccccggagacccagccagccccagcggcactgcaggcccctccccgggggcagtggaaagcgtcttgttgcatctgggctggaaatacaccagcgcggggctgggagtgataccctggcccagtggtttctccagtaataataatagtatcctcatagtgaatgaagccatgctgttctccgcatttgacagatggggagactgaggcatagcggggttatccaaggcgcatttggtgaccggggttcaaacccaggcagcccggtactggggacctccaggcagaaaggaaaggaggccatctggtggtgtgtttctattttttatttttggtggttttttggtcactcttgttaagcacctactgtgtgtcagatgctgcacaaagcacttcacctggattctagggcagcggtggcagagtgttccctgggatttgttagaagtgctgattcttgggccccagtccacacgtactgaatcagaaacctcggggcatagtgcagccacctgcactgtcacaagcccttggagtgcttctcatgcaggctcctgccccagacccccttgataactgtgagaccgagaagttaactgcccattttgtagatgaacaaactgagacccagaagtttcatccctggtcctggggccctcagcgttggcctcccaacgtcctgtactctgactgtggaaggaagggaatgacattgctgaagtcaccaggcagaggaaggccaggggttaaggacacaggaagctgggctcagtgctctcccctccacagcgtggccttgggcaagctgattaacctgtctgcctccatttcctcatctgcacatgagagttggtggtcccagtcttagaggtcttaaaggagtcgtgtgtgaagaactcggcacggagcctggcctgtatgcagccagcgttgctgctgttgctattgtttctaaaaagggtggcctctgctctggggcctgaagggaggtgagaagcaggagagactggagggttggtgggggggcaatgaaggctgaagaggccccagcagccccaaaagcctctccctgcaaccttgcccatccctgaggtcaacacctcccactccaggcatcctgggagcctggttccaccaggaggctgatgacttagggcaaggacacccagagtggctgaagctcacttttcaccctgaacaaccccattattggctggccttgaacaggccattggaccagcctgctcagggctattgcaggtcacctgtggccgctggccagagcccagagggagagggctcatcggtccatggagaagggcagtcggggcaggagagcgagcagcagcgaggcctcactgctgtgcactgggcttcaggcccctcttggccacgttgcctcctccctcccctcccactacttggtgctgcctcacttctaactcttctctgacttccttccagccttacatgcctctgggaatgaggtgcccagaggggaatgcagtggcccaggtacgaatgtggccggctggcctggggggtagggccgggccggggcgggcatcccaaggtccccggtcctccacaaggaaccccgcttctgagcacatgcctctttctgtgagcgccaccgtttgtgctccgcggcctctgggcttccttcccagcacagtggctgttccccatgctggtcccgggctcactccagcagaccagtttcccgtctccactgctttgctgattttcactggtacgcttgggtctccgaccgggtttgatttccctgatagcaaatgcaggggttttcaagtatccccattttacagaaaatgggagacattgagactcaaagaagagccgggtgtgggtttgggggctagagagccaggaatgcggctgggctctccttgccatccttgggtgcgtgctttcatcctgccactccgccagcacagatcgcgctcctgctgtgtaaaacccatgctgaggccgttggtgtgggctgtgcccggggcccctgcacacgcactggcctcgttgtccaccgtgcccggggcccctgcgcacgcactggcctcatgattgtccaccgtgcccagggcccctgcacacgcactggcctcatgattgtccaccgtgcccagggcccctgcacacgcactggcctcatgattgtccactgtgcccggggcccctgcgcacgcactggcctcatgattgtccactgtgcccggggcccctgcgcacgcactggcctcatgattgtccactgtgcccggggcccctgcgcacgcactggcctcactgcccactgtgcccggggcccctgcgcacgcactggcctcactgcccactgtgcccggggcccctgcgcacgcactggcctcactgtccactgtgcccggggcccctgcgcacgcactggcctcactgtccactgtgcccggggcccctgcgcacgcactggcctcactgcccactgtgcccggggcccctgcgcacgcactggcctcgtgattgtccactgtgcccggggcccctgcacacgcactggcctcatgattgtccactgtgcccggggcccctgcacacgcactggcctcatgattgtccactgtgcccgggcccctgcacacgcactggcctcatgattgtccactgtgcccgggtcccctgcacacgcactggcctcattgtccactgtgcccgggtcccctgtactcacactgagcgcattctacactgtcatgtgacgatgatggtggcgatggtggtgcagcagcaggcagtcaccaggcagttgcccttgccctcacaattgccagcttctccgccctgtgagatgggaactattgttctcccgttctgcagatgggaaaactgaggcccaagaggtaacctgagtttcccgtggcacgcagccagtgcggggcagagccggggttagagctcagatgagaacatggagacccccaggacgaaggcctttgcccacggccaccctcaggctggctccatctgtcgggggtgctgaccaccaggaggtcctggggttgggaattaaccaggttatgccagcagggtcagtctgggagaaaggcggccaggcgagggcagcagctgtgggtaggggcctggtcaggggctttgtctcaggggtggggctctaggcagcagcccaggtgtgtaggagcctcggggctgttttggcatcaggcgacagagcggcctcatccggagggtcagggccatgcatctcttctggaggccccgccagaccctgctcatcccctcttccttctcgccctgcacagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggtgagtgggcgccaggcagccctaaccttggcttttgtctgcagacactgagcagcgactacctacttagacagccgcacccagtctggctctgcctgctttgggggagcccgaggtgtggttagggaggcagacttggagtagagtccaggaatgagagatgcaggccaggaaggggcggaggtgtggccgggaggacctccccaggaggtgacatccaagctgagacccggacagaggaggcagccctgggcagcgctagggagagagtgtgccaggcagcctgctcgcttcctagggccgccctcacaaggtagttcgagccaggtggcttttaacaaatacagtcctggaggccaggagcctgggggcaccatgcaggccgagacgcagcctccgagcctctgggcagatccatcccgcctcttccagctcctggccgctgctggcggtcgtgattgctggcatgccactccgtctttggctctgctgtcacatgaccttcgccctgtgcatctctgtgtccacactttcttcttctgaggacaccaggcattggatgggcagctgtcctaatctagtgcagcttcatcttaacttgattatatcagcaaacagtctatttccaaataaggtcacattcacagagaccctgggttaggacttgaatgtaccttctctggggggacacagttctaccctcagcgtggtgggaacagcaagtgcgaaggcccgaggtgggaatgagcttggtggattcaggtgccaaagggtggctcagggagggggcagcctggcaggacggggggcagctctcacgggggtgggggcactgagtcacgccctggcaggtgggggctgcattttgttctcagggcagtgagaaggcctttacgagcctctcccaagagagccagatgtgatttacccatgaaaccatgtgggggatttgctgggagtgagaggcacagtcaggaggcagctgcaagtgccctggggctggtgatggagatgcgagcgtggtggccgtggggttggggaaaagccacaggttcaacatgtttttggtggctcatctcccatcagccaagggtccagggctcaggatcacaggtgatcaccttggatcacaggtgcagaggttccccttgcaaattcctctccagctggggtggcctggaggaccccagtgtcgtcctgtttgggtgttgatgtctctgaggtgtgttctttcctttctggcctctgtctttgctcctggcctgggtgaccccacatccctgagaatgccaccttttacccattttcagcacagatgctttgggcctcaaggcctccagcccagaaccaaagatggctacccaagttagggccaatctcggttggcagagggcagacccgcggagactgcgtcctgctcacatctggatggctggaggaattgttttctggtggggcaggcaggccattttatttcaactacagtgtggtctgttttctcccctcccaagtcccttggaatggtcctgggcagagcaagcgagggaggaaaatcagacccgcagggtcatgcggggcccttgtctctgccctggggttcaccctgggccatgttaaagggggaagtcctaggacattccctaggaactgaggttcacccggatctctataggttccacaaaacaaaatctcagggtccccaggaaccactgccaacaggaaccgcgcccatgcgtgtgagaagtggacggcctgaccctgaccctgtgatgagcaaaggcctggcctgcgggtttctgagggcaccaaatccctgagcttcttgcccgacagtcccagcttggaaaacagtgttcatggtgtggctgggtctgccctggaggcaggcagccagggccattgtgcctggatagcggggtcagggcagacggctccccgccccgctcctgctggctgtggggacagagtcatagaaacacatgtttctgccttcgccgggggaccgctgaggtcatggggcagccccattgataagctgcctcccagagtctgtattttgggtccatgtggctggccccggactggggagccgggggatcagcttgcatcctgtccgtccccagaacactcaggctaggcctgaggccccgcagggcacttgcagcctcccgtcctctcccctgcagccccgcccagggccgtgtcctccctccccgagctgggcctggcgtacgtccaccccttgcccagtgtccagcacacagcccccgggtgcaggagtcctcggctgggagtcaggacacctggtttgtcccgccctgtgcgactaggcccaggcccccgcccttggggcctgctttgccctctcagtgaacgaggctggactctggccagcctgctgacctcgtcctggccggcagcccgccacccctccctctgccggccacgactgcgcagggccgggcggacgctggaggacgcggacgagatgcgtcagagtaggccctggcagccagggcctcccgggaagggctggtgggacgggcgggccccccaggcgacccctgctcctggctgcccgcccagtatcatccctcctgcctggcagccccagtgggggagctctgtgttcctggatggacgcaagatgactctcatctggccccccgccccggtgactttgggagagagaaaatcacattctccttcggcccgctggcactttcttcgaggtggctctgcctgggtgttttcttggcagacgaccagagatagtggcttcaattgcaaaaccccgagcctgcctgccttcccctctcttactcttcagagaaggtgcctgggtgcttttttggcagggcctggccttgggagtcccctcccccaagcctcagttttctcatctgtaaggtgggcgtggatggcttattgcaagaataactcagttaatgacgggccacagtgggcgctcagagattagctgccctcctttggatctgctttgggacaccccctagaggtcaccccaagagggggctggagtgcagctccttcagctgtccctctggcattttggaagatcataacagcaatttcacctttgttactttattctgcaagtgactgatggcaccagcatgcgccaggcgccgggggcgctggaaactgcacagacaaggccctgactccaggcacttacattctagtgagggcatggagaaggaaaccattgtttacgggatgagtgggtgatgggcagatggggcatggggagcaggggagagtgggctggtcaggcagggagggcctctggggaggtgacattggagggcaatgagagccttagtgtgagggaaagccagaccccctgggaaccaccagtgcaaaggccctgtggccgcatgagcgtatgtccagtggacagcagagaggcctatagcagggtgtagagtggagtgagcagcccagggcagagagggcggagaggtcagagaggtgggcaggccccacgggtggaagtgacgggtcagggttttatcttggggccttggagaggcaagggatgcctgttcacaaaccagccctccctctccctcctagccctaggatggtggcaaggattgtcccagcttgatgaccatggggaaactgaggcaagggctgggtggagaggggatgtactgttgcaggcccagcatgttccgatgaatgtccccaggcccttattccccctctcgtgccctgccccccaaccggccttcatgagtgggaaggaaaatgacagtgaggagaaggtggcccgacccactcggccccacgtgctggtcaccagcatccccacgcccacccacggacagcccttgaagctttcgtctccactctccagattgagaaaccgaggcacagttggctaagtcacatggtcagagaggggatccgagcctttgctcgcaactgcagggctgggtaggcagggtggggcccctcccagacacatactctgtgccaggccctgagagtccccgccccacccaggccgccagaaaggaaaatagaagtggctgccttccaagaaaacaaaggagagaggccggtcgcggtggctcatgcctgtaatcccagcactttgggaagccaaggtgggtggatcatttgaggtcaagagtttgagaccagcctgaccaacatagtgaaagcctgtctccgctaaaataccaaaaaattagccaggtatggtggcgtgtgcctgcaatcccagctactagggagactgaggcaggaggatcacttgagcccaggaagcagagcttgcagtgagccaagattgtgccactgcactccagcctgggcaacagagcaagactctgtctccaaaaaaataaataaataaataaaataaaacaaagaagggagagtggagggtggggagagccagccaggagggcttctggaggtggcgctcctccagcatggctacgggacaaggggcggtcagatgggccctgagctctgagcgttttccaccttcctcctccactattggtggccgctccctctgggggcttaggactctcgttcccctcgagaacttgaacccagcccttgtgctggctgctgccttctttacccatgagagagctctggctgggatcagaagacctcttgtaaactataaagtggtacctccatgaccacagtccccacttgctctgggggctcaagaagggtttgggcctctgtgtgtgccccccagagggtacctgctgagagcttctgggcagcagcccctgcccccgctcaccccctgccaatctgactgcccacaccctactaggtgaggggccacagggaaaccaaggcacagggagcactcaggccccacatagaaaacgcgagctctcgggcagactgcatgggacagtggcacctcatgttttgtgtgtgttataaagtcatatttttatctctatagaattatctttacacatatacaaacgtttgcatttcaaccttaaaatttatattttatttttctatttgtacacacatataaaaatattatttttactgttcatagagaaaatacagctgatacgtcgaaccctttatggctagcatatagtatggtcctcatttcattttgtaaccgttattaagatatcattcatataccatacatttcaccattgaaagcgtatcatttaggctaggcacagtggcacacacctgcaatcctagctctttgagtggctaaagcaggaggatagcttgagcccaggagttcaagaccagcttgggcaacatagagaaaccttggctctaccacaaaaaagaaaaaaatgcaaaaatcagtcaggtacggtgatgtgtgcctttagcttcagcaattccggaggctgaggtgggaggattgcgtgagcccagggggtcaaggctgcagtgagattacagcactgcactccagcctgagtgacatagcaagaccctgtctcaaaaaaaacgtgtatcattcagttcttcttagtatattcagtgttatactaagaaagaaaccctatgcccatcactagtcacccctatcctccctcctcccagccctggcacccactcatctcctttctgtccccgatggattggcccgttctggacttttcacagaaacggaatctacactagaggccttctgcgactagcttgtttcacgcgcatcgtgtcttcagggtccacccacgtcatagcccgtgtcagagcctcatgccttttgatggccatgtgttccatcgtgcggacagggcacgctttgtctcctcattcgtctcttggtggatgtcgggttgtctctgccttctggctgttgtgcgctgggcggtgctgcagtggtgggcacgtgcaggtttctgcatagacatttgctctcatttgcctggtgtgtgcctaggagtggcagtgctgggtttagggcaatgagggctcaccgactgctttccaaagtggctgcagcattctcttttaaatttcagcttgcaagtgcgagctggttgaaacggatggtggtaggtaaacctgtggggagggacataggggtggcggcagttgaagccgcaggtggagaatgttgggacaggtgataccatctgtgtttggacctgggtcagggtaccttgtctgtaccttgaggatggcggggagagcacagctgggcccaggtccagggagtgaggcatggcagtggccaaaggagaggctttaggtggtcctgggagatcaagcagggtctggacaggtggagggaggggagggaggagagtgggctggcggtgggggcggtggaggtgcatgcagaagtcagggtgaccttcctcgtctggcccccgtctgtgcgccatgggcagcctaagcaggcatcaccgagtctgtgtctgctctccccgctcagctgagcgtgtggcagatgcagacagcaggctggtacctgcagaacaggccggtcacatgccggtggccccatggtcctgctatggcagagattgaaggaggggactgccggcaggggcctcagcaccctgggcatcggccctgctcatctgcaggaaggagatgggtgcctctgggcgccaggcatccagcactggcagctggggactggggtggtgtgagttgtgtccctgttgtcacagctctcacctcgaggccagtaggctgtgacttatagtctgcataggacgtcgtcactgtggtcacagcacagagtaggggctgtgccgacaggacctgccagcttctggcacccagaagttttgccctctggctgaattccaggcccgtggctgctgccctcacgcctgccatgtggtcatttcactagcttggaagacctaggacagagactgggttctgcgtcgcctccaaatacacccaaatgcaggccgggctgcttccatacccccaaacgtaggccgggccatctccatacctgcaaacgcaggccaggccacctccatacccccaaacataggctgggccacctccatacccgcagacgcaggccgggccacctccatacccgcaaacacggtccaggctgcctccaaatacccccaaactcaggccgggctgcctccatacccccaaatgcaggccgggctgcctccatacatccaaatgcaggctaggctgctttgtgcctagcaaatgcaggttgcaggagggagtcaagaactgggcagccccgggcagccacactgggcaggtgaagggttctcaggctggagcagatccagttcctgcccttggagacctcatgccaagtggggagccagatggggattatggcaggtgctatacccggtgctggggacttagaaatcctggaaggcttcctgaaggaaacggcacccaccgaacagcttgggagccacaccccaatgcacgctctgccaggcaccgtgtaccctgtgtcggcctctggtcgcgcatctcagtagcagacagaggaagggactgcgactgtggctaatgagtagacagtgggcaggccctacctgcccctccacacaaagtctgtggcctgggcccttgttatcatgtcctcgtccttcgtggatagtgtgtgggagagagtctaggaagtgggtgcagctcccccactcctgcctctggtaaccggagctcattcggctccatgcccactgtcttgccctggcacccgagcctctcagattcgagtgatgaggaatctcttggtgaatctcttcatttctctgtccctgaatcgggctgattctttggctttctggcagcttcggaagggccacgtgtggtgtgggccccaggtctgggcttctctgggattttccttgcctggagatgtctttggggatgtttgatcccagcctgggcctctagcactgcccggctggcctctaggctggggtgggaggctggcttggcccctgatggggcctgcaagaaccaggggagtgagtgaggaggcacttgcccgcccactcgtgcctcccctcccctggccccaaatcttggtctgttttcccaagagaaaccgttgacattatctgggtgagctgcacagtcgcctcgtgtctcagggccttagcctcgtccccagggcttgagacaggagaggccatcaaaaccgggcagcccccccaccctgggagagtccggctgtgggcccccagctgatggtgctcgtgtgcccgcaggctgctgtccccaaggcccagcctcctcaccccgactggcgacccccgggccaatgcctcaccccagaagccactggacctgaagcagctgaagcagcgagcggctgccatcccccccatcgtgagtgcccacccccagagccccacagagtccaccctgaccttgactttcccattcattgagacagagaatcccacgggcgggagcatgcacctgcagcctagctcatccgcttctgtttcctggagaaatccccgtggagctgaggtgggaacagctggggaagctggcaggcgtaccgggtggggctcccagtgaaggcgggaactggcggcctaaggcctccccccttccaccccgcagcacccttgaacccccagattagatactgggtcatggggaggcaggagcttcccccacccactcagctatagcaacagcttggccagggaagggtggcctaccagttctgatcctggggccctctgggaacaccctcctggaaggttctctcagctgggtgcgtgggcccttggaggtgccttctccagggaggtgagtctggccttcccagttgcaactgggggctccgggctaaaagaccctgagctgaccaggctggtggtcccttgggactttgagtgatgggctcagggcgtgtcaggctacacggcccagtccccgaggcccacagaatcctgttgctcagtcctggcttccctgagacccagaggatttgggtccacagaaggagctggaggagagagtcacagcaggctctagcctcctgtccaccaccaggctgctaggccaggctttttgggaggtgggctccccctgtccatcaccaggcagctgggctaggctttctggggaggtgggttccccctgttcactaccaggcagctggaccaggctttttaggaggtgaactccccctgtccatcaccaggcagctgggccaggttctgggaggtgggtccccctgttcaccaccaggcagctgggccagactttttaggaggtgagctccccctgtgcaccaccaggcagctgggccaggctttttgggaggtgggctccccctgtccatcaccaggcagctgggccaggttctgggaggtgggtccccctgttcaccaccaggcagctgggccaggctttttgggaggtgggctccccctgtccatcaccaggcagctgggctaggctgtctggggaggtgggttccccctgttcaccaccgggcagctggggcaggctttctggggaggtgagctccccctgttcaccaccgggcagctgggccaggctttctgggaggtgggcttccccatgtgctctgtgctaagacctccctttcttgccgcacctgggaccttgagcatgtcgctggctttcccgggccttggtttccaggctggtcgcgtgcatgtctctccctgaccctgtcactttcagacaccctctgtgaatgctcacttctgcctgcttccctcagcaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggagggtgagtgcacaccagtggctgagtggggctggggcagcaggggactgacgggcaagggatgtttgtgtgtctagagcagctgctgcaaaccccatggccacagtggcagggaaagcaaagtaaacgaatggaacagttgagcagggggaggcagttgggaatggtagggactgcggcaaattggagaactcttgttttctctaaagtgggcacgtattggccttggccaagagtcaccccgtggcaaatcaggcctggggtggttcttccagcaaagccagaaatccatcttatgtgaaatccccctggtccctggtttctcaacactggcaacttctcaaaattttcaaaagcattgtgaacacgcaaaaacatgtctacagcccagcctctgattcggtgtgaatcagtccacgcaggagcttctggaatcacagatggggcccagcacccggctggcagcagctctggggcctgggcaggaagggctgccctccccagctggcatcctgaccttgctccaggcccaggtctctgggttcaccaggagccagggttgggggtgactcccgagccgctgtgtcacagggactgccccgggcacacctcactgtcatcacgtgaagctcaaggtcaggagacaggcgggcgtgattgcttgttctctggatcttcaatctctgccccacttcccactaggcccaagaaattctgaacctgtgtccccaaagaggcatcttctccaggtcagcctggcacgcagcaggtgctgttgtgccttgcaggtgttgggggctgcttccccagaggttccccaccctgggctagccccggcgcttgctggcaggctgctccaaaggtctgagggcagcaggacaccaggccgacctcctgaccagcacagcccagggacaaatccgggtgactggagctaccatcagctgtcccctccccgctgccttgggtgtgacatcccccttctcttttttttttttttttttttgtttgagacggagtgtcactctcgccaggttggagtgcagtggcacaatctccgctcactgcaacctctgcctccggggtccaccgaggctgctgggtcaggacatttgttgaaaacccaaggccccaggcaccatgctggcagagcggggattaggtagggagaagaggaagtctctgctctggggagctgctgttgttttgagtgaggaggatgttaaaccagggaacacgtaacgaagcaagatggttttagagtcgttcatccaccatgagaaacaaaacgggttgagtgaagagcggctccgggaaggaccctgtggagtgggaagcagccccgcagtgggagctctctgggtgggcattgcgggcagagggaacagcacagggaaaggccctggtgtggaaacacgctcggggtgtgtgaggagtcgccgggggtggttgtggccagggaagggtgggcgggtggacagtgagggaagtggggaccggattgtgtggggcctctcaggccacagcgggcagtggattttgtctcaggtgtggcaggggctgctggagggatttgaagtgagcgtgtgttgcggaaggggaaggaggtgcttgttatctgatttgtatcttggaaagctctgtctggccgttgttgagtcaagggcagcagcgggaggtcacagcgcagctcttggcaggcgacagaggctgcctgaaccgcacaggtggccgtggaggtggaaggaagggcgcatcgggagtttgttttggaggcaaagccagtggggcgttgaacccggtgtggggatgacgccagggatgtctcgctggaactgggatgccccatgaccagggctgggctacctggggccagggtacagtgtgcggcccagggtgtggctctgggagacgttgcaggtttggggcgccagcccgggaaggagctgtgtatccatgtcaggggccccagcagctttggccagcgtcagatctgatcagggctggaactgcacggtgccagccaggtcctgctgagccaggtcgcaggcccctgtcctgggagaaagggagccaccggccagcagttcccgcggctggcactcagcccgttggtgtggccagggcctgtgccgtttcctggcctcattccccgtggggacggtgcacctggcgttaggccctgcatgcctttcttgcacagcctggcttgcagctcagctcccgcagggacacacatgaacttgacacccagcgctacctctctggtctctcaggaagccagcctattctgcccctggctcccacacagagcggctcagccaagcaggtccctcggggccccctgggcccaactggaggaacaggttgtctctccaggctctcggccgcccgcccagcctggcctagccccagtttgccttccagcatcgaacagctcccctcctctctctcccaactctctggaactgggctggaggaagcaccagaggcttacagggctgggtagccagaggggccaggtccagggcgtttgcaggatctccagatgtgaggcaggccctgtacaggtgcctccactggggactggttaagaatgagaattcccctgcatctgtgccccctgcctcctgtgggctgcccacctcgccagggcacaagtccaggggaaacagtcttcaaggagagaattgggggcaatttggtacataggccttcttgcccacctgctctgctcacagcaggcatcattaattgatcttagcactctcctccgctgtcacaccctgatgggccctcagaacctcctttgttcatctggaggcggcgtgatagatgacacctgcctgccattcctgtcccagaacccagagggctccgtcattcccaagttgtgtctctgctcaacttcttggccggttatctctccataggattggtcctcagggagaggttcagagctgaggacagatttcagcaaagggcgagaggccagcaggaagatgccatgaagccaggcctgagccccggggccccgctgagtttacaggatctccccaggcctgaaatctaggacccatcattgcttctctgccgcaggccatgtggcatagcagtctggattaaggccatggtctgcagccccagtgcctgggttcgaagccgctatctgccacttgctagctggggcctttgaccaggtggcttaacctctcggcttccattttcccgtctgtgaaatggggacagtcagtcagttccttgtagggtgctgtgagaataaatgagtgaacacgcttacattgctgtcagccgtggagccctgagagagcatgacctctcggtaatgccctttgcacactccgcctggtaagtagccctgcctgagcttggcttctcagccagccagcgcacaaccgctgcttgcactggctcagtgggcttctgatcctgactcggctaagtatttgctggtgaactcagatgagcccattggtgtgtctgtacctcagtttcccctctgtaaaatgtgtctggcagcagtctctgtgtgagcttaaccggaggctcatggaggccgtgggatgctgagcacagtgcctgtgctgagtaccactcagcaaactgaggctgacgctgtggttgttacttggagggtctgggcttataaccccccactgcccgccacaacacacacacacaggcgcacacacatccatgcactcgcacacacatgcacgtgcacgtgcacacacatcacaggttacctccttcaacattgtgtacaggcacacacacatccatgcactcacacacacgcacatacacgtgcacgtgcacatacacacatcacaggttacgtccttcaacattgtgtacaggcacatacacacatccatgcactcacacacacatgcacatgcacgcgcacacacatcacaggttatctccttcaacattgtgtacaggcacacacacacatccatgcacacacacacatccatgcactcacacgcacgcacgtgcgcgcgcgcacacacacatcacaggttacctccttcaacattgtgtacaggcacacacacatccatgcactcacacacacatgcacgcacgtgtgcacacacacacaccacaggttacctccttcaacattgtgtacaggtgcacacacacatccatgcactcacacacacatgcacgcacgtgcgcacgcacacacacatatcacaggttacctccttcaacattgtgtacaggcgcacacacacatccatgcactcacacacacatgcacatacacgtgcacgcgcgtgcgcgcacacacacacacacatcacaggttacctccttcaacattgtgtagagcacaggccagcaagcttttcctgcaaagagccggagagtgaacattttaggctttgtgggccagacaatctctgttgcaaggattcagctctgccatagacaatacataaatgcacagatgtggccacgctccagtaaaagcgtattcacaaagtcagacggcggggccaggcgtgggggctcacgcctgtaattccagcactctggaggccaaggtgggaggatctcttgagcccagtagttcaagaccagcctgggcacacataacaagacctcatctctacaaaaacaaaatataaactagccaagcatggtgtggtgacacgtgcttgtagtcccagctacttgggagcctgaagtgggaagatcccttgaacccaagagttcaagacaagcctggggcaacatagcaagaccccatctctacaaaagtaaaacaaattagccaggcatggtgcggtggtgggcgcctgtattcccagctacttgagaggctgaggtgggagaatcacttgagcccagaggtgaaggctgctgtaagccgtgacagcaccactgcaccccagcctgagtgacagaaggagaccctgtctcaaaaaaattagggggcagacagaccctctgagataccatttgccacctcctggcttagaggcctgtccagggaccttggcttgctgggcttggttgagtgcttgtggggttgcaaagccagagggtcccgttctcgtcctcagcggcagctgagagcccccagctcagaccttgagatcccctcccctgctgagcagaataccatggggttacagagcagcgcccaggcaggcagacttggggggcttcccggaggagcccaggccgtcacaggccaccactactgtgggtgcaggaaggccatttgtgtagggtcagccagggctcccgaggtctgactgccccacctcctgccctcagcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtaagtagctccgcccgagcttgggcttcttcagccagtgcacaatcgctgtttgcactgtttgcactggctcagagctgcacacagaagcatcttaaagccttatgggacctggctggaggaacagcctggtcagtggagggaaagggggagatcttttaagaaagctgccccagggttgagatggaagccactggcaagagggagccacagcaggtgcttgagctggtgaggggcaggcttagagtgggagctatgttttccgttgacggcttagagctagagaatgggcagatggtagaagagcctggggagggagcagaggcgctaccttggttcacagactctgtgaggctgcatttcggccctgttctaggtcctgcagtcctgctgggcctcaccagctgtaaagcagcacagccgggggctggtacagactgctgttggtaaaggctggtcccgagggatgcgtgggccaagggagccagaagaacagggaaagtcatgccaggcagacggaacagcaagtgcaaaagcccagaggcaggagagagcaggcaaagcttgagaaactgaatctggccaccactgccgaagctcggtgcccagtgagctggggagacccaggggccaggtcaggcgagcctgaaggccaagtcgggggctaagactttctcctgaggacagtgggagccatcgagggcacacagcacagggagggtgtgcaccagtagacttttccaaaaaggtccttttggttcctataaggggaaggggctactgggggctacagtggaaatggggagacaggggatccagatgagagttgagggcgcttggatcagggcctgggcagtgggtgaggtgggaggcttccccaggatagtggtgtctgcacctaggactcgggtcactaatgaggacagagccaggcagggcaatagaggagtgcgcatggatgggcacttcctggccaggacagggaagaggtggagtgcagcctggagtgtgtgtccggcagggacgtgaccgctcctgggccccacaatggacagacatgtgctccacaggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaagtgagtggtagcccttcctttcttgggggcttagtcttcttatctgtaaagtgggggcaatgggaccaatgaagtctgagtgggggccaggctctcgggggcctgggtcatctccactcaggcatctggggtctgagctggctgggtcctgccccaggcactcagggcctcgtccctggggggtcactctgtattgcagtcaagggcatggctcaggaaccaggctgtgtggcctcaggcaagttacttaacctcctgtttcccccactgcgaaatggaagggcaaatgcaaggggctcagagggcatggccccttcacaggggagggggccgaggcttgggagtagcagtgacttgtctgccgtcacacagctggacagcagccccagcctctgacccacacgtgggctttttgaacaggagcgtcaggcactctggactgtgggggagggaccagggtgcccctgtgaccccacaactccgcccctacagggaatgtcggtccagctccacgtcccgtactcagagcatgccaaggccccggtgggccctgtcaccatggggctgcccctgcccatggaccccaaaaagctgggtaaggctcctggcccatccgtctgggtggctcaggctgggctctggctgtcctgtgggtggggcgggggaggaaggggtatcttggcccacggtactccaggtagcagctgggaggtcccccctcagcagccctggctggaacatggtggggaggggcagcgcttcccagcccctggctcaggttgggtggggacaagcctcccgggaccctgctccggcagcacgtgactcgctcctcttactggtcctcagcacccttcagcggagtgaagcaggagcagctgtccccacggggccaggctgggccaccggagagcctgggggtgcccacagcccaggaggcgtccgtgctgagaggtgagggcccttctgccctgggcccccagcatctgcccctgttcctcgggtgcccaaagggccctttattcaaaacctgctgggaagtgtcatctcccagagggtctgggggcccctcttcacagctgtctccctcaccatttaggggtagggggactccctctgcgttgaaacaactagcacaacttgtgggtctctcagtcagggtggctctcaggactggggcctggggaaggaagggccacagacacgccctcagccccacatcttgtgtcttccagggacagctctgggctcagttccgggcggaagcatcaccaaaggcattcccagcacacgggtgccctcggacagcgccatcacataccgcggctccatcacccacgtaggtgtcctggggtgcggcaggaaggacggttgggaccagcacggggccagcccatcttataacccctcattgtcaccaaaccattagcctcagccgatggggtgatgactgggggacagcagttcactccatgaactttcatctagtctgcatggaatcaggcactgggattgccaagcacagctcaaaactctgccttcagggagctgccatgtagtggaaggaaacagaccagggtaaataagtaggctggtgaaaaccgagcaggcaggcagaatgtgagcgtaccgcggctgagaatgcctggccacggacattgcttagacaggtgaggaaggtgacatgtcagctgtggccagaagaaattgagggtgcaagccatgcgggaatctcagggaacagcattctaggctcagggaacagcatgtgcaaagacagagcatgagagggttcctgaatcgtgccaggactggtgccccagccttgcagctggtgagctgtggacccaaggttttgtgccacgtgtgtctggctctagaacacagtgacagagcgtgggtccacacacttgcacacgtgcatgcatgttctaacagtggagcttcgggcaacaagatggtccacagggaggtgtttttcactcaggcagcgtcaaatcccaccacagaggagccatttacactttgcccttctctgaaatctgcaggttttaaaaatctgagctttcaaaggcagctgtgctgagtgggaagggcaagtgctttggacaaaagtcaggctgagggccctcgggtgccagctccaccacctactcagacaggcagcggcctgccctgactccgtttcccctttgctaacagtattcctgggagagtcattctcctgaagtcgtagggacctttgaagttcccaggcatccacctgctctgggttcctgagtggccatgacccgcgcccttcctcgaacctcccagttacacacatctctttgattgcttttggcagacagccagctgccaaaacatgtgagataggcaagggtcaaacttccgtgcagtctcactaccagatagtgaggaagtcagcgtgtggcctgcacgcacagagccgtttattaactgagtaggtgccataggcagggaccacgtggttcccagctggcaagggaggtcaaggaagtcccagctccctgatcctccagggacttcctgcccatcttgggagtagagttcattggggccaagagcaagaggctacaggctcatctcctggaagcagacgttatgcaaacagaagcttccctgttaatgggagtttgtccagtgtattctcccaagagcaggggccaccggctggatttctgttctctgtccatgtccctgaagatggcacctctaaaatactatagctcaaaaacatcaagctggacacggtggctcttgcctgtcaacccagcattttgggaggccaaggtgggaggatagcttgagcccaggagtttgagaccagcctggacaaaaagaggcctgtctctacagaaaatttaaaaattggctgggcatggtggcacatacctgtagtctcagctacttgggactgggaggcaggaagatcacttgagcccaggagtttgaggctgcagtgaactatgacagtgttctgcactccagcctgggcaatacagcaagaccccttctcaaaaaaaaaaaatcagatgcctcagtttcaccatggagagcccccctttttaaatcatttattgtggtgttcagtaagccactgatttctgcagtacaaacccagttctgacatggaccatctgatgttagggctggatacagaaaggggtgcacttgtgttagctgcctcttggggggcttttcccgccaggatgctgcaggaatcctgtgctttcctgatgggagaggtggctgccccgagctgtcacctgactcagcacctattgtgccacactgttagtgtacaggtgtcttaaagcacagcagggagatgctgctcagagtatttgctttgggaagtttggggggagctcatcagaattcagggcgtcttgctgttgccctccgcaaagaccaggatctgcggtgaactccccggggtaccaggtgctgccctctgccaggggatgtccccagccaagcaagtccagccagagactcagagctcactggtccaggtcttgggatatagtaggacctttaccgttgaatctgctcctggaaccctagaaagagaagagggatattgagatttggggacccgtcgtctgtgccagatgcctttgagaatcatcaatgcagaaggtctccatttgtggatgtgcaaactgaggctcagaaaggaggtcccacggcagcttggtagtaaagttgctgtttgacacccaacattctgcttccaaagtcatattctaactctgatgcttgtgttcttgaaagtcacccaaggcaggatgctgccccacgtggccatctcctctctgcttgaacacatcctccaacgggaagctcattccctatatggcagtggttctcaattgggggaaattgtgcctccaactctctagggacattttcgattgtcctaacttggtgggggacacactggggaggcgtgtactcctggcttctagtgctttgaagccagggatgctgttaacagcccacagtgcacaggacagccccacagcaaagaagggtccagctccagctgtcaggagggccgaggtggaaaacctgggttagaactaaaatttccggtgtgctgccctgacgtgagtccttgtcctggttttaggaaaccaaagtgcatgacgtggtcacgggtacagcacaggagcagaaaccccagcgtccccgccagttaccgttttcggtaactgaatgtcaaggctctgagtagaccccacgcagtggtggggacacagactccaggaccagaatgcctgggttcaagtccccgcctgccccttattagccaggtgaccccgggtaaagtcactgtgcctccctgtgcctcggtttccccatctgaaacaggcataatcaatagggttgtcttagggttgtttcgaggattaaatgagcaaatccatagagagcacccagaacagcgtccactcatgggaagcacttgacaagggatcttcattcttcaggttcctcatagggttttgttccatgcaaactcttacctatttgagacagtgtgtgtgtggacacgcgtgtgcatcggtgggcacatgggcttttaagcacgtctttgcctgcatttgagttgagaggggtcctgggctgcagcctcctgggcgctcacccctctgcacctgcagggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtgagtcgcaggaggagaggaggcccaggaccaggggaggagtgtgcttggcccactgaggtagcttcacagggaggcagggctggattgacatcagaaagcacaatctgataggtggtgacctccttatccctgcaggtatgcaagccagcagcagggaagcgttggccttagctgcctcccacctctgcccagttctttacagtttagaaaacaaactcatggccaacctttttagaagcataggagggaaactgaggcccggaacagaagcccgagctcacgccgccaggcctccagcaccgtactgacaaaccacgcactctctcattggccatgaaagaggccatggccagagtgcccctcgccccactgtgtcccaggctcttgctgcggagcccccatcctctccctctctaggctctgggttccagaacgaggagaccctgccaggaaggagttaagggaatcgagtgccgggaaagagaatttcctggcagcctagggcacccaggggtgtggagatgaaagctgctaatgggcgcctctctcagcactgcagctgcgaggcccggaattgcctctcctccatccacttccgcctgtgcccgcagccccctccccaggcctgggaggtggaggtggcaccgtgtggcttaggaacataatgcactccctgctgccacagagatagccttggagacaggcctgcagctgtgtcttgggtgccagctcatgccctggtgcccctggaccgagtgccctgggggtggcgggaagcctgggaagggctggtggtggggttagtcaagagcttgtcttgagaggtcactgggtagagtcccaccttgggaccccagaccagtgcctgagcctttataggccttcagcgtatcgtcttcatcatgggtttcagtcggggcctttaaactctcgtctgctccctgggccaggtaggcagtgcaggcagcggcaggtgtgagactgtagggagtggggaggactgtagggaatggggaggactgtggtgcctgctcacgccgtccactcccctgcggccaccggtcagccaggtttctcatctccgtttttatctgaaatctcccgatgtttaaacatcggcgattaatttggaacgttttctgaacagcaacctagtaccctcctgttggcaacccctggagtagctcacgggccgtgggccacacgaagcaatggttgaaaagcccgagagcctgtcagttgctcattccctctgaggggtggggcgggggctcccggggctcatttctgatagctctggactcggctgccctggaaggagagccctggctagatgggcaaagcccagcctttaccttcgggggccacctccgtctgttcacctctctgcctgtccggggagcagtgagccgggcccatgtaggctcctttggcctggcgaggccacccctgccacccctcaccactgcctgcaacacacacctctccgtgcacacgcagacttgtggtcggacactcacatgcacatcggcacaggtttctgggtgtgacacgtgtatacatacaaagccgtgtactgcctgcaccctggtacatgtgtgtacatggacccacttagttctcagcagccaggctcacgtgcatgtgcccacatccactcctgcacacacaagacccgtgccagtgcacatgcgtgctcctgcctgccacacgtccacacactgctgatgtatcggtgcacacgcgtgctcctgcctgcccgcacctccactctgctgtatcggtgcacgcgtgctgctgcctgccacacatccacactctgctgctgatgtatcggtgcacgtgtgctcctgcctgccacacatccacacactgctgatgcgtccttgctcacgtgcatgtgtgtgcacttgttcacgccccatgtcggcacccgtgggtgtggacacagactcacgtgctcatgtggtcacaggcacacccttgcttgcagacagagcaccctggagggctagggtacagggtgcaggcagcgtgccctgcatctcccaccgtgcaaccccctggaaaagctcctgggtcctgctggcaggcccccagggcctgcaggctgccagctccctctggaggcctcggctgtgaggctttgtgacggggccagcatggaagcactgctggctcctgcctaccggctctgcctgtcctgcctgcccaccgtggtcctgggcccgtgcccagctcctcaccgagtgctttgtgtggtttccaggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtgatagcagggaggagacttcatctctcggtgccccctggtgggcggtggggggatggctgaccccgttttacagatggggaaaccgaggctgggctttctgaggctccatctggaggtagcgcagggaccttcccgtgctgggtcctactccaccatcatcgtggggatgaccactggcggctgtaaacactgacccctgtcactgcccagtgtcggctcagggagccacggaatgatggcctcaccctctcctacccaggtctcatgggccgtgccatcccgccggagcgacacagcccccaccacctcaaagagcagcaccacatccgcgggtccatcacacaaggtactgccctgttccctgctccctcgttgcccccaacgggtgtacagtcacgcagggcgcgggagggagagacacagccagagtgtggtgggaactcaggacaagtatgcagaaaggcctgcagcacacatgtacatgatcagtacgtgagctacggagcaagggtgtctcttacttatttcaaaacaaaaacaaaaagcaaaataccaccgatcacccctgtgcttttaggtgtcacatagcaactgtcctgtgcttggcactaacccaggtgccacctgcgtatcgttttacagaacatcctggtgaggcacatgcgattgggagaggcttggagagctccgagaactctttcaggttctcgcggctggtccatggcacagccagctactgtgaacttggcagctttgtgggttttattttttatttttttattttgttgttgttgttgctgtttgagacagggtctcattctgttgcccaggctggagtgcagtggcacgatctcagctcactgcagcctccgcctttcaggcttaaacaatcctcccacttcagcctcccaagtagctgggaccacagatgcacaccaccacatctagctaatttttgtatttttgtagaggtggggtttcaccatgttgcccaggctggtctcgaactcctgagctcaagctgtctgcctgccgcagccccccagagtgttgggattacaggcgtgagctactgcacccagcctgtggttttagcttcatgatttcatagtgttcccgacttgctgaggtggttcagttaatattcttgttttatgtgtgaagaagctgaggcccagagaggtcagatttcctggtcaaggtcacacagcaagtggggatttgaactcaggcagactagctccagaacccactggtgtggaggctcttgatgggtctgggtggggcggggcgtgagggtcagtgctgtcggcccggcagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcaggtatggcccagggccaggcacacgggcccagttctaggaggggtggcggtggctgtggggcactgccctgggcctctccacatggggaaaccgaggctgagagccctcgcgtaccttacagtcacccagctgctcatcaccgggcctcagctgtgcgtgttccagggctgcgcagggggcaccaggctcctgacctgattctactgaactcacattgttcccattcttcagggagggaaactgagtcccagagaggccaggcaggcttccaaggccacaggactaaacatagtgacgagtaactgcctccgttgaatctttgtgagggtccaggtgcggcctgaggatgttgcatgcgttcattgtttcaccccctagcaatgctctgaggtcgttttcttaatgaccttattttattgctgagtaaattgaggttcagagaggttcaacgactcacccagagtcacgcagcaaatgcagttgtgaaacccaaattcagatgttcctacagccgcagcatccactgcacccaccagcaggttgcaccacaagaggccccagtccccccaggcggccccagctcagtaggggaagttccgtgccgatggtacgaggacgaggagctgttcggtggaaagcccctgaaggccactgtccttccacatgggcagaggtggcctcttgtgaaggggaaggagaatgggagccaccacggggctgtggggctgtgaggcggaaggactggggtgggtgtcccgggaggggttccagcttgtaggaaggttttgaagccagggagaaggcagaagcagtaagatccctgattgccaggggaagggtttggctctcagcccctaggcaattatggagtccttggaagcatccaccgcatgaccaagacagggtccagattctagaatattcttttgaaaaacaagggcagttccccttcttacgacagtaatgaagacatccctaaatagagttttgttgcttgcaaagccctaaagtcccaccatatcaagtgtctccgaagcctgctgaaaagaggcaggggacctggtggcctggctacgaaggtcccagtctggactgtgacccccccatttcctcaccatcctttctgtctggagggcaaacacctcagccctgacctcagtgtccctggggctgaaagcctcagggcgggtagtattgggtctgggtgctgactttttctgcttggcattgggtgggccatggagggtcccaggctgaacagaggaatgttttttacccacatgagggtgttgggcttctttctcgcaaactccagggaccatcagagagcccaccactcgcggcagggagagttgactgttgaactttttacccctttctgcagtccccccagggagcgtggggaccagggtcaggcccagggtgcgcagggcagtaagtaacaagtgtgccatctcagggttagcaaagccctctgtctccctgcctctggaggcatcagatgtcacttccatcttatagatgacaaactttttgaggctcagaagggggatgcagctggtctgggctatggctgtggccagggctagagcttacatcccctctgccccagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggtgagtggggtgtgcatgggcgtgagtggggtgggcgcctgtctggagaagctgtgcctccccatccaccattagcttagtttgcacctgggatatcctcgccacccgctttccaccacatccaaaccacctgcaggcccgtgggctctgcctccgattccaaaccctgtccaactccttgccacctcccagaccaccgtggtgtctcacctagcttcccccacgcccctccctcttcctgctgtaatccactctgcaaacagctacccggatactttctaaaaatgcaaatcatattattccacttccctgcttccatccttctagcaacttcacacattttgctatggccttggggcgcctgcctgttggggccctgcctgcctctcattcagccggattccttcgtcctccccagccccagcccctgggccctctttctctttgttccctggccatgcttagctcggtcaattcagtatttgctgggggcctttgcgtggctcctcctctctgcctgccatgtccccgccttccagatctttacttagtgggtttctttccatccctcaggtctttgtttacatattacatccttggggaggcttctaaccagaccccctatctccagttcatatcacatgctgtgacattttaaaattgtcttccggccaggcatggtggctcacacctgtaatcccagcagtttgggaggtcaaggcaggcagatcacctgaggtcaggagttcaagaccagcctggtcaacatggtgaaaccctgtctctactaaaaatacaaaaaaataaccgggtgtggtggtacgcacctgtattcccagctactcgggaggctgaggcaggagaatcacttgagcctgggaggcagaggttacagtgaacggagatcgtgccattgcactccagcctgggcaacaagagtgaaactcttatctcaaaaaaaaaaaaaaatgaaagaaaattttcttctgagcgtgtttcactctgtaattctcatttgtttgctagtttatcacctgtctctcgcattgaatgtcagcttgtgagggctgggatttctgtttcgttcactggggtgaccccagttctcacaacaatgcttgccacgtagtagaggctgcatcaatattttttaattgattgagtgagtgaatggatgaaagaatgaattttttaaaaactataacacaaaagcaaatgagtcagtgagcaaaaagtgaactaaggcaatgaagaaatgaaggagtgaatgaagagacctggtccttgggatcccgaggtccctatcctcaaacaactccccgtaaatgccagccccagaggcccgatgcatccaccttgcccgtccacaggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcaggtgattgccctggggctcccagaaccctgcagtggtgctgaacagggccacggacctcatcagtgttcgctcagggactccttaggcatcaactgtcaggttcccctggatggcgaaactgaggcctcgggattggaagacccaacagtgtaatcatgagcttaggttggagcagaatttctcttagtagtttgcaggacatgtggggttaaacatttcagtggttttcttttccggcaggacttatcagtgcctttagcaatgcaaaggtatagaatgaggacttgagtatatgcatttttcaaatagacatgatctgaaagtcttttttaaaagttgccgggcacggtggctcacacctgtaatcccagcactttgggaggccgaggcaggcggatcacaaggtcaggagatagagaccatcctggctaacacggtgaaaccccgtccctactaaaaatacaaaaactagccgggtgtggtggcgggcgcctgtagtcccagctactcgggaggctgaggcaggagaatggcgtgaacccgggaggcggagcttgcagtgagccaagatcgcgccactgcactccagcctgggcgacagagcgagactccttctctaaaaataaaagaaattaaaaaaaaagaaataaaaaaagttgcatccctttggagtgttaatctgcattgggatgtcctatgtttgggacaactttgatgcaaaaagcatccttcgtagaagtcaccctcttgtgtcctggcgtgatgttttcctgctgtccgacgctcagttctggtttgtgctttgggcagccacacatgtaggtgggagaagctgtccgggtgcagaagtagggggcatccagacaggtggagcgacaccatcaggcctaggtatggctggcctcacatgagctcccctctgccccgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggtgagtgggtgggcagaccacctccgctgggtttggccttattcccaaaggacatgggcgtgcccctgtggcctcgcggaggcagctagacctggtcaccttgtgggtcaccttgtgtgaacggacctgagtgggtggcctggggttgtgcgtgctgtgggtgctggttggcatctggtaggtgagtgcacagcgtgtggctcctggctgcatcctcagtgggtgtgcgtgcatctgtgtatactcttaggatacaggggcctcaggagtttaaagatcaaaatgtggccgggcacagtggctcatgcctgtaatcccagcacttggggagggcgaggcaggtggataacaaggtcagaagttcgagaccagtctgaccaacatggtgaaacccgtctctcctaaaaatacaaaaattagccaggcatggtgatgcgcacctgtagtcccagctactcactaggctgaggcaagagaatcacttgaacccaggaggtggaggttacagtgagtggagattttaccattgcactccagcctgggcaacagggcaagactgtgtctcgaaaaaaaaaaaaagatgaaaatgtgaggctgtttggagtttgttcctttgccttgtaaacagcccacagctgctttgcgtgcacacgttccagggccatcctcagaaatgcttctggaataaccaagttctagctggggctcagctggaaaagctgaagtcacacttaagtattttgaacagtgaggattgaatacagggaatggattgtgtaggcgtcagaggctgaaggggcacagagggcctgagatgggaaccagtgagggcagctgcaggagatgccccggctcgggcttgggagcagaagaggaggtggtaccgagagaacctgagcattcagaaaagggttccatggctggtgctgggagccgaggagggagtgcctgccaccagctctgctggctccaggagtgtgtgccgtgctctccaggagggtgatctggccggtgggcagcctggcctctctcctccctgtggctacagccctggcccaacacctcccgcaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggtagcgccactgcccagtctggggtggggaccccggcatccatgggaggcggctgggggatgggcgggcagaagccctgctctctttcccaccccagaagacaaagccaggctcttcttcggccctggggctgagtctctggcctttgggtttcctaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtagggcatcagagcccccaccccccgctccgggactccttgtgggccgcaagaggcctccccctgctgatgccactgactgtcaccaggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtgggccaggttggcatgggggagggggcgggcaggtggatgggtggtcagtaggaggatgagcagataagaggatgcttggtgggaggtatatgggaggtgggtgggtgggcagatgtgtgggggtagaagaatagactatgtgtgagtagtggatgggtgggtggtcgggttaggtgggtgtgtgggtcagtgggaagttaggttagctgcgtgggtggatggatggatggatgggggggtggtcgggttaggtgggtgggtgggtcagtggaaagatagatggctgggttagctggttggatgggtggatgatcaggtttggtaggtaggtgggtgggtggaaggatagatggccgggttagccagataggtggttgggttaggtgggtaggtgggtcagtgggaggatagatggttaggttagctgggtgggtggatggatggatgggtgggtgatagggttaggtaggtaggtgggtgggtgagaggatagatagctgggttagctgggtggatggatgggtgggtggtcacgttaggtaggtaagtagatgggcaaaaggatagatggccaagttagctaaatagggtgggtgggtggtaggtaggtaggtaggtagtgggtaggtaaaaacccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacactttgctgaatccagaaacactgatgcaagaggtgggtttccatggccttaggaagctccacctctgtggctttgcagagtacagccccctcctgcctgctttcatgggctggcattgagtgtctgccacttttccaggcacatggtgcaagctgtcaatggagctaccattctggggtttggagaacaatggccctcttctcacagcttcactagtccctaactggggactctgtttgggggctctgactctacatttcccttctgcactgccctaacaaaggttctccatgagggctctgcccctgcagcaaacttctgcctggatatcctggcatttccatacatccactgatatctaggctgaggattcaaatccacaactcttatgctctgtgcatctgcaggcttaacaccacatgaaagccactaagtcttatggctgacaccctatcgagcagtgggttaacatatatctggagcccttttagctacaactggcacttgagtggctgggacacagggagcaatgtcccatggatgtgcagggcagcaggtccctgggcatggacaatgaaaccattcttctctccaagacctctgggcttgtgatgggaggggctgctacaaagttctctgaaatactttcaaggcattttcccacattgtcttggctattaacattcagcaatgttacatatgcaaatttctgtagatggcttgaattactcccataaaatggggtattcttttctagtgcatggacagactgcaaatattctaaacttttatgccctgcttcccctttaaatataactctcagtttcagacatctcattgctcacacatatgaccatatgctgttagaagcatccaggcgacatcttcaatgctttgctgctcagtgtgtgggggtgtactacaatacattcatgcttatatacaatgcatttgaggttgaggcatgtaaaaatactaaggcactgtgtgtatgttgtttgtgcatgatactgtaactccttgtctctgaaaacagtacaaggaacaggatgtgtgataaggagtgctgaagacagcatcctaagaatgtggttgatgcttcagatgaataaataagtccatatgacctcatgcctgcccccaaatagccacctgttgatgaattataatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttagtgcttccttcaggatctcttgtacggcaggcctgttggtctcttatcatttgcttgtctgtaaaggattttatttctcctttgcttatgaagtttagtttagctggatgtgaaattctgagtagaaaattattttctttaagaatcttaaatattgccccccactgttttctgactcatagggtttctgcagagagatccgctgttagtctgatgagcttcccttgtgggtaacctgacctttctctctggctgctcttaaccttttttcctttatttcaactttggtgaatctgatgattatgtgtcttgggttacccttctctaggagtgtctttgtggtgttctctgtatttcccgaatttgaattttggcctgtcttgctaggttggggaagttctcctggataatatcctgaagagtgttttccaacttgcttccattctccccatcacttttcaggtacaccaagcaaatgtagatttggtcttttcacatagtcccatatttcttggaggctttgttctttccttttcattcttttttctctaatcttgttttcacattttatttcattaatttgatcttcagtcgctgatatcctttcttccacttgattgatttggctattgacacttgtgtatacttcacgaagttctcatgctgtgtttttcagctctatcaagtcatttattctctactccaaactggttattctagttagcaatttatttaatcttttttcaaggttcttagcttccttgcattgggttagaacatgctcctttagctcagaggagtttgttattacccaccttctgaagcctacttctgtcaattcatcaaactcattctccatccagttttgttcccttgctggcgaggagttgtgatcctatgaaggagaagagacattctggttttgggaattttcagtctttttgcactggtttctccccatcttcatggatttatctacctttggtctttgatgttggtgacctttggatggggtctctgagtggacatccttctgttgatgttgatgttattcctttctgtttgttagttttccttctaacagtctggcccctctgctgcaggtttgctgcagtttgctggaggtccactccagactctgtttgcctgggtatcactagcggaggctgcagaacaacaaagattgctgcctgttccttcctctgcaagcttcttcccagagggacacccaccagctgccagccggagctcttttgtatgaggtgtctgttggcccccactgggaggtgtctcccagtcaggcaatgtggggtcaggacccgcttggaggaggcagtctgtgatgaactattctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccctcctcagcctccagagtagctggactacagtgtgcaccacaatgaccagccaatttccttgatatttttttaagagatgggatcttactacgtggtacaggcctcagcctcccaagtagctgggattataggtaagagccaccacacccagcccaaattagattgtttctaaagagatattctgaccacgcctttaaatatctaatcataagtcacctactgaaaaaccgtccttgacttctgtattagtttcctattgctgctgtaacacaaacttagtggcttaaaatggcacaaatgtattgtctgacaattctggaggtgagaatctagaatgtgtctcactgggctaaaaccaagatgccaggctgcgttctcttctgaatgcctagcgggaaattcattgtcttgccttttaccacttccttggagaaggagtctacatgctttttttggcgcatggccctcttctgtattcaaagctagcaatggctggttggatctttctcaaactctatcactctgacctgcctctgtcttctacttttaagtaccttgtgattccattgggattgtctggataactcaggatagtctccttattttaacatcaactgtttaacaacattaactcgctctttaactctggtttctctttgctatgtgacataagacacttacagtttttgagggttaggatgtggacatcgtggaagggagacattattcctcctaccatggcttcccagtatctagcaaacccatcctggctgcctgggtcttctacactgtgggctcgaatttactctccagccttacccccaagacctcatgtcgtatgtgccctcgagttccacacacaccagtccatccagatcccccaacacaccccacactcacacagctcatagcattgtttcttgcattttatcttctttgatgttctcttcattccacgctgcctccctttactcaccaccaagatgaaactctgttcatcctcggacttatagcaaatgcatctttctccatgaagctttccccctaactttttccctctggatgttcatatcataatgtttgtacctctctgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgatttgtgggttggtggtggcgttaagtaggtaggtaagtgggaggaagaaagaatggcccagattagccaatgtgaaggaaaggatgggggggtggntaagttaggaaggtaggggggtgggggagagtatagacgctggcttagntgggggggtggatgggtgggtggtagggttagggaggtagntgggtgggtgagagtatagatggctgggttagctgggtgggtgggtggatgggtgggtggtagggttaggtggatgatggaatggatggttggatgagtaattgtggggatgagtggatggaggccccagtggatggacgatgagttgggcggtgggatgagtagatggggaggttgtttggtttgagaatagaatctgtggagagggagagactgaatggggactgtgaggaaagactttcccggtcccccacatttagcaaggccagcaaggaaaagaggtgtccctcttgcctggacaaagtcccaagtttctctgagatgggagaggcccctgagtgccctctggtgacacacactccagagactgtgggcagagctgcttcaccaggggggtggggtcacacctcaacacccttccctgcccggaacctttttttttttttttttttgatggagttgtactctgtcgcccaggctggagtgcagtggtacgatctctgcttactgcaacctccacctcctgggttcaagtgattctcctgcctcagcctcccaagtagctgcagttacaggcacgtgcaaccacacccggctaatttttatatttttagtagaaatgcggtttcaccacgttggccaggctggtctcaaacttctgacctcaagtgatctgcctgcctcagcctcccaaagtgccgggattacaggcgtgcgccaccgcactcagcctccaggacctatttagaggcaacttactcctccaaaatgaattttcattcaaaaaagtacttgtgccccaacttgccgcttggatgcctgaagtcatacctcccctaatcattatttcaattatgaaaaatggcatcgtttcccaaaagcagtggcgactttgtcacccctgactcagacccagcaggtgcatgaagcactaatccctggctgtggggagcagggttccgcacacaggctctgtgggatatgcccgtgacagccgattcaaaaatataatggagaaaacgagtgcctgcccactgcccgctcatgaatgaggctctgggaggtagagttagcgagagatgggggtgcccccatggaaacgcagggctccgggaaggccacgtgggtggagcagccggctcctgttccagccccagccctgtgcaggggcagctgtgccccagcttctcactcacagagctgggaacagcagctttctctgttctcaacgcccaccctggccgccccctggcatccttccccttgctctctcactcctcacgtggcttttttagctcttcgggtatcctgagcaggcccagctccctcatgtgccccctccctgaagacctcctagccctgcctcagcttccttgccgttctctcctggtacctcattgactacctccacacagttaccaggctctgtagagcttgggatatctgttaatgtgatcgtagtctgttttctgaattagatggtaagatgcttgcatccgttttatgaccgctgtattcacagtgtctagaacagtgcctggcacctagtagctgcttaatcagaagttttggaatgatgcaaggaatgaatgaacgaatgagtgggatgggtcaaaccatgacgcacagagtctggcaggttacagtcaggagggcagtttcactctgggagcagcaggggatgtggatttatcccagggcaatggggactcatcgagggtggtggaggaagagggcagctcccatgactgcctgaccgccttctctcctcccccaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggtaagaccaccctgacagcggccaccttcatagacgcgattatcatgcgtcaaattgctcacgataaaggggcgcgagaaggaggtgcgctggccaacggctcccctcgcgatggtaagacttccggcccgcacccaccccgtctcgtggtccaaagatattttcagatctctgctttttactttggcccccgttttttttgttgttggttttggtattttgttttgaagcccatccgtcctcgccggtttgcacgcgctgacgactactccggccgcgcctgcccctctggtttgggggcgctcatcatttgcacatcattttaccatggttttttttttttggatttttgcttttttttctttaatgaatggatctgtgattctgacttcgactgcgcccccatctccctctttgcgcctgtgtccagggagcagggatggggctgcgggagggctcgggcctacgcccccacctgccggctgcctggatgctgtcggactgggggaagtggaggcaggcggtgcaaggagaagctgaggcggggcagggacctgcgctgtcgaggaggagctgggtctggctcttgcatcttgccctgtccccagcccctgtaccccagaaaaaggggagccctctgcctctggacccctgccttggccctagttcatggctcctctctgttggactgggatggccgaggctatagcccaggcggggccccggggacccagggtcactcccagccacacccccacttctcactccgccccacacactccttccccagagacccatgctgcccccatctcacgctggcctcgcccggcctccaccacctgaacccatctctgtcccttcttgcctaatctctctctgtgtctccctctctgtctgtctctgtcccgggctctgcatctctctccacctctcccttggcctccctgtctctccccaacacccctctctgccttactgtctttgggagcccaaaccctacccctagcttgggttccccttgacccccccggggtcccagccagctgggagggcagccctgcccctcgggctccgaaaccctgggcccggtgcctgactctgcaccccccgcctgccctaggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggtacgccccacccagtacccaggcccccgaagccctgcacagtgaggaccctcaaggccccatcatgcagataggaaaacagaggtgcctaaaggccaaggaattggctggatcatgaggctcaaaggcatggggctgggatttgggcccagcagccctggggccagcagacaccccctgaccagctctgctctgcctgcaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgtaactacgcgttctctgctgctgcttgtcacctttgcacctgggggcaccaggcctggagaggggatggggaaccccacagcccttctgtcctggcggggtggctgggggatccagggcatggcgctggggggatccagggcgtgggtgagggtgagatcccaaagccccgagcaccggcaccatcaccgccccctaatccatgggaggagcctgtgatgcgagccgatggcatcttcacgggcaatgaggccttcctggtggcccaggtttctcagtgtcatgggctggtctcatcagccatctgccaactaccagcttgggaccgctgaccacagccccactcccatgcacactgggacacggaggcccagagggtggcgggcaggtccacagtcacccaggaagctggccccacccaggattctgccccgagctccgtctagcccctccccacccccagaaggttctgtcaggagagtgctgcctgactctgggcccccccacttgcctgcaggaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtgagcgagggatgggggtgcctcttgctggtcagccggcgggaggccttcgtcagctgcctgcctcagagctgggtctgagctcagctgcatatgaggcccgcctggtgccattgcacaggcaagaaatggaggctccaggagatgggggagtcacagagcggatacataacgaataatagctgatgaaagtacatgctgtgctcagtgggttccaggcactcacgtgtaccctttacacacagccccccaggagacataggcagcattctccccatttcacagatgaagaaactaaggcctggagaagtgaattcacttgcccacaggggcacagtcagtaggtgacagagggggatttgttccagggctgtatgattagagagcagcctttccacacatgcacacccacacacatgcgcacacacacacatgcacacccgcacacatgcgcacccgcacacacacacgtgcacacccacacacatgcgcgcgcacacacatgcacacccgcacacatgcgcgcgcacacacacatgcacacccgcacacatgcgcacacacacatgcacacccgcacacaggcgcacccgcacacccctgtagacacaggcacatgcacatgctcacgcacactcccactcccacccccgcccccacccccaccctggtgaaccgtggggcctctgggggtcaaaagagaaagagaggggagggccctgagctccagggtgaaggaggcgttttggtgggggcggggggggtaatgtgtgtgcgaggacagacatggcaagacagcaggacatctttggggggcagtggtgtagctggcactggggtacaaccagaattcagagcaggggtcaataaactgtggcccatgggccagatctagcccgggccctctgtttgtacaattcatgaactaaaaaaatgattttacatttttaaagggttgtttaaaaaaaaaataaaaatgataacgatacatgccagagattacttgtggtcgaaaatgcctaaaacgtttatgatttggccacgtacaggaaaagcgtgtggggccctggtttagagtggagggagggtgcgccccctcagtagggagacctctgaccacatctggggccctttctccatccaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccaggtacttctgtgggcacatgcgctgcccccgggatgctctggtatcccttgcccatccttggccccagtccaccgtggtgccatgtggagagtgacaagggcacagggctcagctgggtgacctcaagcctgccaagcaggtttcaccaacttgggggtgtgatacatgcccaccctccctggggagacctcagtggtagctttccatgctttgggctgggatctcagctggaccaggcccccgttgacagcccctgttgaacctctaagaaataatgagctaggtgtgctgggccagaccgggggcgatgggtgaggtgggacctgagaaggaagctgggcccgctgcccctggggaagggcatgatcggaacccaatttcagtccttggggctctcttgagagggtcaggctggagcaagtggtcagaggcagcccaccacgcagccaggcgtctcccaagacacccctagccccaggacgggtgaaccgcagaggagatttcaggagccgtgatcttctaccaggcaggggatgcaggcgtgggggcgggtgaagcttgcttccaaatgtctaaggcatctcaggtggtgagttccccatcatcaaaggcatgcaagctcggcaccaagtgagctgatgtgaggtgtttgatcctcacagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacagtaaggggcctgcaggctcccggggaagcatggggccacaggtgggcgggtggcctgcctgggcagctggagccgcccagtggcagaaacccacggtgcaccttcgaaagctaagtggccctgctgaccacctccccccaggccctttgcctcacatttggggagccccagggcagtttcttgatttgctgggctttccataggagcttactggcacagaagaatagcacccagcacatagtaggtgcccagtgaatacctgcatgaatactgggaccaggggttggatccctcccacacaagggccgggcgcctcccacactcagcacctgtgtggctttgcacccattgacgtggttgctgggtatgaacgccccactctgcttcccagtccctagcacagcgcctggcagttagcagatccaccagggaatacgtgagtgggtgggcaaataaagaatctgtcacagtccccgaccccaagaagcctcatctgccagggaagtttggacaaatcacagatgcttttcccttcctggggctggagtagaaaccttgcagatagtcactggcttgccgggcacggtggctcatgcctataggcccagcactttgggaggatgaggcaggaggattgcttgaagccaggagttcgagaccagtctgtgcaacatagcaagaccccatctctacaaaaaactttaaaaacaggcacacacctatagtccaagctactggggaggctgagataggaggatttcttgagcctcggaggtcaaggctgcagtgagctatgatcacaccactgcactccagcctggacaacagagcaagacactgtcttaaaaaaaaaaaaaatctctgacccaggctggtaactccagggccctgtaagtgcagtccagggaaccgtagcatcagcatccccagggtactggttagaaatgcaggcccttggccaggcgcggtggcttacgcctgtaatcccagcactttgggaggtcaaggcgggtggatcatatgaggtcaggagtttgagaccagcctgaccaacatggtgaaaccccgtctctactaaaaatacaaaaattagccaggcgtggtggcggatgtctgtaaccccagctactcgggaggctgaggcaggagaatcacttgaacctgggaggcggaggttgcagggagccgagattgcacaactgcactccagcctgggcaacagagcgagactctatctcaaaaaaaaaaaaaaaaagaaatgcagacgcttggccctgtcccaggcctgctgcatgagaacctgcaatgcacaagtttccccaggtgatgccagcacacctggcctggaccacacgggactggtagggcaggtaattcccagagacctgggggcctcacccactctgtcacccgcttccagatatcagccagcctgggacggagatcttcaatatgcccgccatcaccggaacaggtaacccatccagcccttgctatatggctgccctggtcccctccgctccctccccacccctgctccagctgtcatgaagggacgaggagccttcgctagtctgggtgtaccccctcattctgggatgaactaaccgcacagtaggattcagagtcacacaacaggcaggcgaggcttgttccctgtgtagacaggatcctcgctgtgcagggaatctctggagttaagatcccctcgggtggttagtaagtatcagatgcaccctcaccagctggaaactcaccttgcttcttcgccagcctcagctggagatgcacatgtctggacgaggggtgggcctgagctcagagcacaagcctccgagttcactcgggcgtttgttatagctagagcttcattccttaaatccagccagggaactgggaagccttactttttctttcaagatcaaatacaggtgtgtggcagagataggtgtaaaattgacacgcacttttaagctgaaacttaagacttctatgatcttttggacttaggggtcccttgaggttggagccccatcctctaggagggccccattgtgtatttccttggtgagtctggggtgtggcctctgggggtcactctgcatgggcaggcctggcccagtggggctgaggcagttttggggtcggctgcctctgtgtgggtgcctggttatcctctggtcctttggtggaagctgaggccaggatggaggtcggagaggtttgctgatcttccctggggaacattcctgggccttgagccctgggaatggtgagcgaaggatagtcgttcagatattatcagggggtcagcgaggcctccaaatgggagtcccaactaggacacctccacctgcccagtgactagacaccgggggcattgccaagcctcaggcaacgggaagaagacaatttggtcgaaacaacaagagggttagaaatgaatgttcctgggatgttctaaatcttgaagtaggtgctagacacacaggtgtatctgtgtgtaaaaactcatggcatggtacagtgaagatttatgctaacacttatatataaatattttgtatttatctttttaagacacggtctttctgtcacctaggccagagtgcagtggtgcaatcacagctcactgcagcctccgcctcccaggcttagatgatcctcctacctctcagcctcctgagcagctgggactacaggcatgcgccactgcacccgagtaattttttatcttttttgtagagacaggctctcaatatgttacccaggctagtcttgaactcctgtcctcaagctgaggatcctcccacctcgactgatttttgttttttgtgtttgtttgtttgtctgtttgtttgacagagtcttgctctgtcgcccaggctggagtgcagtggtgcaatcttggctcactgcagcctctgcctcccgggtttcagcagttcttccacctcagcctcccaagtagcgggattacagacacccgccactacacctggctaatttttgtatttttagtagagacggggtttcatcatattggccaggctgatctcgaactcctgacgtcagatgatccacccacattgggcctcccaaagtgctgggattacaggcgtgagcagtcacgcccagcctgattttttctttttatgcagttttagtccacaagaagaaattttccaggctccagtctttgccactcaacctgtgtcagacttcacctttataaatggagatcgttaagcctggagccagctccatcaggtcacggactcgtggccttgggtagaaggcccagtcgcgctgctgtgatttcagcactcacccttgttggaaatgttgctttttcttcatgcacatggctgttttttcaaaagtgctgcagaaatgtggccaagacagcagaaaaggtgtgagcatccctggctacaaacgtatttgaaaccaaaagggaaaagaaaacgcaggcagccagcagttgctacagaaacgtgattttcaaagcatctgcatcacccgcaacctcatggaagcctcggtttggtttacaaaggagcgagtggtcggaaagacgatttgaccactttgtattcgtatgattcattcggagcagaagtttaaaactccatgaaacacttgccccgtggtgggcacggtggaatggggcttcactgggggcttttgaaagcaaaggctggtttaacaaaagttctgaaaagacagcacctctggggggtgtgcaaaggcccccacctccacgtggttcacaagaaagaaaaaagggaaaggaaatgtggttaacagaaaaggaggtttccccgattgtcaggaggtgttctggaagcatcctcttgggaccggtttgttgattcgaccactttgtccttgggactgggcagctgggccagctggggccggaccagggctggtcccgtgattgtgtctacttctgccctgtcccctgcacgcaccgtaactgcatggctatgaccccgccctcagcgtccgtctctgcacctctttctcctcatggctcctgggtggggagaggcagagggaggagagcaggcccagcttggtggggaggtacggggctgcacgtcccatcacacaggtggaggtggggcagcgggaggaccatctggtcaccttctctctctcagtcccttccccagcccccagccagcccccagctctggcttgagccaattttctagcagcctgttccccaaacagggtagccctcccatctcccaccctctccattaaggccacttgagatttaaaaaaaaaacaaacaaaacagccccagctaggattggaggtgcagacggggcttgtgatttcccagaggacagaataggaatgagaataggggctggtgggggcatctgacctcccctaccccacctccctggcagtgcccaagagcttccggggccccaggtagaaggaaccagcctctccccttttatcaccacccagcaggaaaaaaagggtggggagggatagggaaataaatatgttgctttgccgaaatgtgctcactgtgtatttctctctcctcctcctcctcctcctccttccctctctctctcccttctctctctctgtcgcccctctggctccccctccccggcccccatgtgtctgtctgtctgtctgtctctctctcccaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtctgcaggccacccccgccccgcccccgtctgtccccacccccggtgtgattaatcctcgctcctccgcgctcctctgacaaccccctcctcgagctttggagcttgtgactttatttttgtgcgtgtttgacctcgttctggagtttgctaatctgaagctgggctgacaccccccaagtgtctgtaccctctgccccccagccccggccctcctgcccactaggcccgaagcgctgccgcctccctcggacactcacactgctgtccgccccccagtcctcccgccttcctccctgcggggacccggcttcttggcccatctgtctccttgggggagagcaggctggagtgaagccccacccacactgtgtggacaggggaatggcagccaggcctgtgctcagcatctgccaggcccactatgtgtcctcagctgccccttagcctggtggggaggagcccagggtctgtctcagccctgggagtcagggagccttaggggtcagcctggttccccatcaataccctctgtatcggggcagggagctgaggagagagttgcagttgtccaacctggacactgaggccccaagaagcttctggagcctctgtgggggtcaggcctggcctcaggggtcctgacttctctgcacggggcctggatcctgcctagccttagcatggtcctggggccacgctcaaactggaagcccagcttcatgcttagggttccagcccctggggctggggtcgctgcaggacagcccagggggctattgcaaacagcagacagtttagccacctccccctgcccagcagaaactatctccaccctccaggctcatggctggccatctggtcaaccctggcttcccagctggggcgggcagcagggaggaggggttcacgttactgctctccctccctctttggagggcccatggcaggacctcaccctgcccctgtggccccaccgtagcgtcggtgctgtcttcactgcccaacgcagccccttcccatcttgtccccctgcaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggtgggcaccaggtggggacagggctgggctcgctgagcccccaacactgggctgtgaatgctgccggggcactgaatgctgagcgcctgctgcatgcagagctcagactcgggcctgttctgtggaaacgctgtccaggggcctgggcagctgagcctggctcacgaaccatcaggatgcttctgccaggggcacaggcagaggaaaagggtgtggttggggccggccagatcacatgggcctggtggaccatccaggggagcctggacttcctttgatgggtagtgaggaggcgtggagggctttcggaagggaaatgctcatctaacatagggtcagaaggcccctgggagaatagaccagagggacggtgaataggctactgctatagtccaggcaaaagacagcggcagggtgtgaacagggacggaagtagaacaggtgaagagaggcagacggttctgagacctgttcgcaattagaaaggtctgggaggactgttggacagaaacgctgaggcctctgttcccggtgtggtgggcaggcggccagcaggggctgccgggctcacagaggcctcctgggcatctttcgcttcttcccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactccagttacaaaggtttcttctctacctcagactgggcagccaatagggcaggcgtttaggggacagtgggagtatacccctggagggccaaggccacatccgcctgagtcaccagggagtggatccttttgcaagttgaatatttatacccttggtaaggacatcaccatgaggacatcaaatagtcacatctgtggtgaaggtctcaagtgttcacacccatggtaagagtgtgtcagatgttcacatgggttcacacccatgtgtcaggtattcacatgatggtcagggtgtcatgttcacactcatggtgagagggtgtcaggtattcacacccatgtatcaggtattcacaccatgctgagggtgtcaagtagtcacacccatggtaagagtgtcagatgttcatactcatggtgttaggtattcacaccatggcgagggtgtcagatgttcacacatggtgtcaggtgttcacaccatggtgagggtgtcatgttcacactcatggtgtcaggtattcacaccatagtgagggtgtcagatgttcacacatggtgagagggtgccaggtattcattcccatgtgtcaggtgttcacaccgtggtgagggtgtcaagtggtcacaccatggtgagagggtgtcagatgttcacacccatgtgtcagg

SEQ ID NO: 4 - DNA, 8660 bp, Mus musculus
ggcatccccgtccccgcgccagccgcccgcgcccgccatgcgcgccccgcagcggcccgcgcgtccgggccccgcgtcgtagcgcggcgggcggagaccgcaggctctcagcccggacccgccgcatcctcgagcccgatcggcgccgtagcccggcgccagcgcccggtgccgccgccggcgagtgctcctgagtctttgaggaacacagcctcctggtggaagttcgtggacgtggggctgcttgagtaccaacaccacccccgtgactacacctcacacctgtcacccggttccatcatccagccacagaggaggcggccctcactgctgtcagagttccagcctgggagtgaacggtctcaggagctccacctgcgccctgagtcccgcacgttcctgcctgagctgggcaagcccgacatagaattcaccgagagcaagcgcccccgcctggagctactacccgataccctgctgcgcccatcacccctgctggccactgggcagccgagtgggtctgaagaccttaccaaggaccgtagcctggcaggcaagctggagcctgtgtcacctcccagtcccccgcacgctgaccctgagctagagctggcgccatctcgactgtccaaggaggagctgatccagaacatggaccgctggaccgtgagatcaccatggtagagcagcagatctccaagctgaagaagaagcagcaacagttggaggaggaggccgccaagccgcccgaacccgagaagcctgtgtcgccaccacccatagaatcaaagcaccgaagcctggtccagatcatctacgatgagaaccggaagaaagccgaagccgcacaccggatcctagaaggcctggggccccaggtggagctgcctctgtacaaccagccgtctgacacacgccagtaccatgaaaacatcaaaataaaccaggcgatgcggaagaagctgatcttgtactttaagcggaggaaccacgcgcgcaagcagtgggaacagcgcttctgccagcgctatgaccagctcatggaggcgtgggagaagaaggtagagcgcatagagaacaatccgcgaaggagggccaaggagagcaaggtgagggagtactacgagaaacagttcccggagatccgcaagcagcgggagctgcaggagcgcatgcagagcagggtgggccagcgtggcagtgggctctccatgtcggctgcccgcagtgagcatgaggtttctgagatcattgatggcttgtctgagcaggagaatctggagaagcagatgcgccagctggccgtgatcccgcccatgttgtacgacgcggaccagcagaggatcaagttcatcaacatgaatggactcatggatgaccccatgaaggtctacaaggaccgtcaggttaccaacatgtggagcgagcaggagagggacaccttccgtgagaagtttatgcagcaccctaagaactttggcctgattgcctcattcctggagagaaagacggtcgctgagtgtgtcctctattactacctgaccaagaagaatgaaaattacaagagcttggtgaggcggagctatcggcgccgtggcaagagccagcagcagcagcagcagcaacaacagcagcagcagcagcagatggcacggagcagccaggaggagaaggaggagaaggagaaggagaaggaggccgacagggaggaagagaagcaggatgcggagaacgagaaggaagaactcagcaaggagaagacagacgacacttctggcgaggacaacgatgagaaagaggccgtggcctccaaaggccgcaaaactgccaacagccaaggccgccgcaaaggccgtatcacgcgctccatggccaacgaggccaaccatgaggagacagccaccccacagcaaagttcagagctggcttccatggagatgaacgagagttctcgctggactgaggaagagatggagacagcaaagaaaggcctcctggaacatgggaggaactggtcagccattgcccgtatggtgggctccaagaccgtgtcccagtgtaagaacttctacttcaactacaagaagaggcagaacctggacgaaatccttcagcagcacaagctaaagatggagaaggagaggaacgctcggaggaagaagaagaagaccccagctgcggcgagcgaggagacagccttcccacctgccgctgaggacgaagagatggaagcatcaggcgcaagtgccaatgaggaagagctggcggaggaggcagaagcctcacaggcctctgggaatgaggttcccagagttggggagtgcagtggcccagctgctgtcaacaacagctctgatactgagagtgtcccatccccgcgttcagaagccacgaaggacactgggcctaaacccactggcactgaagcattgcccgctgccacccagccacctgttcctcctccagaagaaccggcagtagcccctgctgagccctccccagtccctgatgccagtggcccaccatccccagagccttccccatcacctgccgcacccccggctactgtggacaaggatgaacaagaagccccggctgctccagctccccagacagaggatgccaaggagcagaagtctgaggccgaggagatcgatgtgggaaagccagaggagcccgaggcctctgaggagcccccggagagtgtaaagagtgaccacaaggaggagaccgaggaagagcctgaagacaaagccaagggcacagaggccattgaaactgtgtctgaggcaccacttaaggtggaggaggctggtagcaaggcagctgtgaccaagggttccagctcaggtgccacccaggacagtgactccagtgccacctgcagtgccgatgaggtggacgaacccgaaggaggtgacaagggcaggctgctgtcaccaaggcccagcctcctcaccccggctggagatccccgggccagtacctcgccccagaagccgctggacctgaagcagctgaagcagcgagcagccgccatcccccctatcgtcaccaaggtccatgagcccccccgggaggacacagtacccccaaagccagttccccctgtgcctccacccacgcagcacctacagccagagggtgacgtgtctcagcagtcgggaggaagtccacgtggcaagtcccgcagcccagtgcctcctgccgagaaagaggcagagaaacccgcattctttccggctttcccaactgagggcccaaagctaccgactgagcccccacgctggtcatcgggcctgcccttccccatccctccacgggaggtgatcaagacttccccacacgccgctgacccctctgccttctcctacacaccccccggtcacccgctgcctctgggcctccacgatagtgcccggcccgtcctgccacgtccccccatctctaaccccccacccctcatctcctctgccaagcatcccggcgtacttgagaggcagctgggtgccatctcccagcaggggatgtcagtccagcttcgtgtgcctcactcagagcatgccaaggcccccatgggccctctcaccatggggctgccccttgccgtggaccctaagaagctggcccccttcagtggagtgaagcaggaacagttgtcccctcggggtcaggctgggccacctgaaagtctgggagtgcccactgctcaggagacctctgtgctgagagggacagcactgggttccgccaccagtggaagcatcaccaagggcctccccagtacccgggctgcagacggccccagctacagaggctctatcacccacggcacgcccgcagacgtcctctacaagggtaccatcagcaggatcgtcggtgaggacagcccaagtcgccttgaccgggcacgagaggacaccctgcccaagggccatgtcatctatgagggcaagaaaggccacgtcctatcctatgaaggtggtatgtccgtgtcacagtgctctaaggaggatggaaggagcagctcgggcccaccccatgagactgccgcccctaaacgcacctatgacatgatggagggccgtgtaggcaggactgtcacctcagccagcatagagggactcatgggccgcgccatccctgagcagcacagcccccacctcaaggagcagcatcacatccgaggctccatcacgcaaggcatcccgaggtcctatgtggaggcgcaggaggactacttacggcgggaggccaagctcttgaagcgagaagggacaccaccacccccaccaccacctcgggacctgactgagacctacaagccccggcccctggaccctctgggtcccctgaagctgaagccgactcacgagggtgtggtagcaactgtgaaggaggcgggccgctctatccatgagatcccgagagaggagctgcgccgcacacctgagctacccctggcaccacggcctctgaaggagggttccatcacccagggcaccccactcaagtacgactctggggcaccctccactggcaccaagaaacacgacgtgcgctccatcatcggcagccccggccggcctttccctgccctgcacccgctggacataatggctgacgcccgggcactggagcgtgcctgctatgaagagagtctgaagagccggtcagggaccagcagtggtgcagggggctccatcacacgtggggctccagtcgtcgtgcctgaactgggcaagccacggcaaagcccactgacttacgaagaccacggggcacccttcaccagtcacctgccacgtggctcccctgtgaccacgagggagcccacgccacgccttcaggaaggcagcctcctatccagcaaggcgtcccaggaccggaagctgacatctacaccccgggagatcgccaagtccccacacagcactgtgcccgagcaccaccctcaccccatctccccctatgagcacttgctccggggcgtgactggtgtggacctgtaccgtggtcacatcccattggcctttgaccccacctccataccccgagggatccctctggaagcagcagccgcagcctactacctgccccggcacttggcccccagccccacctacccacacctgtacccaccttacctcatccgcggctaccctgacacggcggccctggagaaccgccagaccatcatcaatgactacatcacctcgcagcagatgcaccacaacgctgcctccgccatggcccagcgtgctgacatgctgaggggtctgtcaccgcgagagtcctcgctggccctcaattatgccgctggcccaagaggcattatcgacctgtcccaagtgccacacctgcccgtgctggtgccaccaacgccaggcacccctgccaccgccatcgaccgccttgcctacctccccactgcgcccccacccttcagcagccgccacagtagctcaccgctgtccccaggaggccccactcacctagctaaaccaactgccacatcttcatcggagcgggaacgggaacgtgagcgggaacgagacaagtccatcctcacgtctaccactacagtggagcatgcacccatctggagacctggtacggagcagagcagcggggctgggggcagcagccgccccgcctcccacacccaccagcactcgcccatctccccccggacccaggacgccttgcagcagaggcccagtgtgctgcacaacacgagcatgaagggcgtggtcacctccgtggaacccggcacgcccacggtcctgaggtgggccaggtccacctccacctcttcgcctgtccgcccagctgccacattcccacctgccacccactgcccacttggtggcacccttgaaggggtctaccctaccctcatggagcccgtcctgttacccaaggagacctctcgggtcgcccggcccgagcggccccgtgtggacgctggccatgccttcctcaccaaacccccggcccggggcccgcctcctcacccagcaagagctccgagccccgatccctagcaccccccagctccagccacacagccatcgcccgcaccccagcaaagaaccttgcaccccaccatgccagtccggacccgccggcgcccacctcggcctcagatctgcaccgagaaaagactcaaagtaaacccttttccatccaggaattggaactccgttctctgggttaccacagtggagctggctacagccccgatggggtggagcccatcagcccggtgagctcccccagcctgacccacgacaaggggctctccaaacctctggaagagctagagaagagccacttggaaggggagctgcggcacaagcagccaggccccatgaagctcagcgcggaggctgcccatctcccacatctgcggccactgcccgagagccagccctcatctagcccactcctccagactgccccaggcatcaaaggtcaccagagggtggtcaccttggctcagcacatcagtgaggtcattacgcaggactacacgcgccaccacccgcagcagctcagtggcccccttcccgcccctctctactcctttcccggagccagctgccctgtcctggatcttcgccgcccacccagtgacctctacctcccaccccccgaccatggcaccccagcccggggatccccccacagtgaagggggcaaaaggtccccagaacccagcaaaacatcggtcctgggcagcagcgaggatgccattgagcctgtgtccccaccagagggcatgactgagccaggacatgctcggagcactgcgtacccactgctgtatcgagacggggaacagggcgagcccaggatgggctctaagtctccaggcaacaccagccagccgccagccttcttcagtaagctgactgagagcaactccgccatggtgaagtcgaagaagcaggagatcaacaagaaactcaacacccacaaccggaacgagccagaatacaatattggccagcctgggacggaaatcttcaacatgcccgccatcactggagcaggccttatgacctgtagaagccaggcggtgcaagaacacgccagcaccaacatggggctagaggccattattagaaaggcactcatgggtaaatatgatcagtgggaagagcccccgccgctcggcgccaatgcttttaaccctctgaatgccagcgccagtctgcccgctgctgctatgcccataaccactgctgacggacggagtgaccacgcactcacctcgccaggtggaggtgggaaagccaaggtctctggcagacctagcagccgaaaagccaagtcgccagcaccaggcctagcgtccggagaccgacccccttctgtctcctcagtacactcagagggggactgcaatcgccgaacaccactcaccaaccgtgtgtgggaggaccggccctcatctgcagggtccacgccattcccctacaaccctttgattatgaggctacaggcaggtgtcatggcctccccgcccccacctggccttgcggcaggcagcgggcccctagctggtccccaccacgcctgggatgaggagcccaagccactgctgtgttcacagtatgagacactctcggacagcgagtgaccacggattgggggggagcggtgccaggtccccgcacaaggcagaagcagcccagcatggagcagacagctgctgactcccgagactgaggaaggagcccctgagtctgcctgcgcgtccatccgtccgtccgtccactcatctgtccatccagagctggcatcctgcctgtctaaagccttaactaagactcccaccccgggctggccctgcgcagtgaccttacactcaggggatgtttacctggtgctcgagaggggagtggacaggaggggagggacagcgggccaggagggggggggacagcaatcgtgtgtcagtcgcactcgtgcatctggggcagcggggacccaccacaggctgaccaggcacctccatgccaccgcctcgccccttaccgcatttggaaccaaagtctaagctgaactctcgcgtggtcctgcccctccctctgcccccagcccgcttgcgctctggacagacagacgttcccagcttatcctgccctaatgctgtcatcatcgcagtctccaaaggccacccagcccacaagactgggagcccatcagaccaggtgggtgcacaaggggccaggcctggcctggggcacggatgcttgcaggaactggaccgtttcccggcctgttgctgtggcaacgggagggaaggcacgtgtaaatggtgttggcttacagggtatatttttgataccttcaatgagttaattcagacgtctcacacaaggaaggactcgcccgtgtttctgccgctgtgctttggtctctacctactgtttcagaggcacgtgccagccaaggcggtggccccaccatacgcaggacttgggggtcaggggctccggcacacggcactgtgcccttcccccccacccccttccttgggcaaaatggacttgatgcgtattctgtggccgctctctgtgcacggcggcattctgtcatttacacatgttgttccaattagaaagcaaatatactcaagtgacaacgtt

SEQ ID NO: 5 - DNA, 20 bp, Artificial Sequence
  Synthetic oligonucleotide
agtcctcgtcatcagctcac

SEQ ID NO: 6 - DNA, 20 bp, Artificial Sequence
  Synthetic oligonucleotide
ctcttggcagtggtggccct

SEQ ID NO: 7 - DNA, 20 bp, Artificial Sequence
  Synthetic oligonucleotide
atgttcctgcaccgcctggc

SEQ ID NO: 8 - DNA, 20 bp, Artificial Sequence
  Synthetic oligonucleotide
ctccagcgaggctgtgtcct

SEQ ID NO: 9 - DNA, 20 bp, Artificial Sequence
  Synthetic oligonucleotide
tcactggcaccagaaactgc

SEQ ID NO: 10 - DNA, 20 bp, Artificial Sequence
  Synthetic oligonucleotide
tggagcccgacatggtggtg

SEQ ID NO: 11 - DNA, 20 bp, Artificial Sequence
  Synthetic oligonucleotide
ccgtggcggcaccagctcca

SEQ ID NO: 12 - DNA, 20 bp, Artificial Sequence
  Synthetic oligonucleotide
gctggcccaccctctgcatg

SEQ ID NO: 13 - DNA, 20 bp, Artificial Sequence
  Synthetic oligonucleotide
gctgttggcagttttgcggc

SEQ ID NO: 14 - DNA, 20 bp, Artificial Sequence
  Synthetic oligonucleotide
ttgacagtggcttcagcctc

SEQ ID NO: 15 - DNA, 20 bp, Artificial Sequence
  Synthetic oligonucleotide
aggcttctctgcctccttgt

SEQ ID NO: 16 - DNA, 20 bp, Artificial Sequence
  Synthetic oligonucleotide
tgtgctgggaatgcctttgg

SEQ ID NO: 17 - DNA, 20 bp, Artificial Sequence
  Synthetic oligonucleotide
ctccttgggcagcaagacgg

SEQ ID NO: 18 - DNA, 20 bp, Artificial Sequence
  Synthetic oligonucleotide
gccgccacctggcgaggtga

SEQ ID NO: 19 - DNA, 20 bp, Artificial Sequence
  Synthetic oligonucleotide
tgttctgagtcactcgctgt

SEQ ID NO: 20 - DNA, 20 bp, Artificial Sequence
  Synthetic oligonucleotide
catcatttacatctgccttt

SEQ ID NO: 21 - DNA, 20 bp, Artificial Sequence
  Synthetic oligonucleotide
ggcccaccctgctctgcatg

SEQ ID NO: 22 - DNA, 20 bp, Artificial Sequence
  Synthetic oligonucleotide
gcatgtaaggcttcagcctc

SEQ ID NO: 23 - DNA, 20 bp, Artificial Sequence
  Synthetic oligonucleotide
ctcattcccagaggcatgta

SEQ ID NO: 24 - DNA, 20 bp, Artificial Sequence
  Synthetic oligonucleotide
ttgacagtggctgggccact

SEQ ID NO: 25 - DNA, 20 bp, Artificial Sequence
  Synthetic oligonucleotide
gctgcgaaggcctccttgtc

SEQ ID NO: 26 - DNA, 20 bp, Artificial Sequence
  Synthetic oligonucleotide
atgaacctaccagaaactgc

SEQ ID NO: 27 - DNA, 20 bp, Artificial Sequence
  Synthetic oligonucleotide
accagacaaggctctgggct

SEQ ID NO: 28 - DNA, 20 bp, Artificial Sequence
  Synthetic oligonucleotide
tcactggcacctgcgggaaa

SEQ ID NO: 29 - DNA, 20 bp, Artificial Sequence
  Synthetic oligonucleotide
acccccttaccgtgtgcgtc

SEQ ID NO: 30 - DNA, 20 bp, Artificial Sequence
  Synthetic oligonucleotide
cccagtgtcctgaattccta

SEQ ID NO: 31 - DNA, 20 bp, Artificial Sequence
  Synthetic oligonucleotide
cagccttcttctgcagggtg

SEQ ID NO: 32 - DNA, 20 bp, Artificial Sequence
  Synthetic oligonucleotide
cgctggcccaccctgctggg

SEQ ID NO: 33 - DNA, 20 bp, Artificial Sequence
  Synthetic oligonucleotide
gaccgagttcagccccaggc

SEQ ID NO: 34 - DNA, 20 bp, Artificial Sequence
  Synthetic oligonucleotide
gcatgtaaggctggaaggaa

SEQ ID NO: 35 - DNA, 20 bp, Artificial Sequence
  Synthetic oligonucleotide
acattcgtacctgggccact

SEQ ID NO: 36 - DNA, 20 bp, Artificial Sequence
  Synthetic oligonucleotide
ggcttctctgctgagggcag

SEQ ID NO: 37 - DNA, 20 bp, Artificial Sequence
  Synthetic oligonucleotide
gctgcgaaggctgggaagaa

SEQ ID NO: 38 - DNA, 20 bp, Artificial Sequence
  Synthetic oligonucleotide
cacttgttacttactgccct

SEQ ID NO: 39 - DNA, 20 bp, Artificial Sequence
  Synthetic oligonucleotide
tcatatttacccatgagtgc

SEQ ID NO: 40 - DNA, 20 bp, Artificial Sequence
  Synthetic oligonucleotide
ggcctgcagacctggcgagg

SEQ ID NO: 41 - DNA, 20 bp, Artificial Sequence
  Synthetic oligonucleotide
gccgccacccatgagtgcct

SEQ ID NO: 42 - DNA, 20 bp, Artificial Sequence
  Synthetic oligonucleotide
gtaggctttggagccaagac

SEQ ID NO: 43 - DNA, 20 bp, Artificial Sequence
  Synthetic oligonucleotide
ttgcccagctcaggcaggaa

SEQ ID NO: 44 - DNA, 20 bp, Artificial Sequence
  Synthetic oligonucleotide
ttggtaaggtcttcagaccc

SEQ ID NO: 45 - DNA, 20 bp, Artificial Sequence
  Synthetic oligonucleotide
gatgttttcatggtactggc

SEQ ID NO: 46 - DNA, 20 bp, Artificial Sequence
  Synthetic oligonucleotide
ttaaagtacaagatcagctt

SEQ ID NO: 47 - DNA, 20 bp, Artificial Sequence
  Synthetic oligonucleotide
caagccatcaatgatctcag

SEQ ID NO: 48 - DNA, 20 bp, Artificial Sequence
  Synthetic oligonucleotide
tcagacaagccatcaatgat

SEQ ID NO: 49 - DNA, 20 bp, Artificial Sequence
  Synthetic oligonucleotide
catccatgagtccattcatg

SEQ ID NO: 50 - DNA, 20 bp, Artificial Sequence
  Synthetic oligonucleotide
aggcaatcaggccaaagttc

SEQ ID NO: 51 - DNA, 20 bp, Artificial Sequence
  Synthetic oligonucleotide
tccaggaatgaggcaatcag

SEQ ID NO: 52 - DNA, 20 bp, Artificial Sequence
  Synthetic oligonucleotide
taatagaggacacactcagc

SEQ ID NO: 53 - DNA, 20 bp, Artificial Sequence
  Synthetic oligonucleotide
gtcaggtagtaatagaggac

SEQ ID NO: 54 - DNA, 20 bp, Artificial Sequence
  Synthetic oligonucleotide
gggcaatggctgaccagttc

SEQ ID NO: 55 - DNA, 20 bp, Artificial Sequence
  Synthetic oligonucleotide
tgaagtagaagttcttacac

SEQ ID NO: 56 - DNA, 20 bp, Artificial Sequence
  Synthetic oligonucleotide
tgggaacctcattcccagag

SEQ ID NO: 57 - DNA, 20 bp, Artificial Sequence
  Synthetic oligonucleotide
tgggtttaggcccagtgtcc

SEQ ID NO: 58 - DNA, 20 bp, Artificial Sequence
  Synthetic oligonucleotide
ttcagtgccagtgggtttag

SEQ ID NO: 59 - DNA, 20 bp, Artificial Sequence
  Synthetic oligonucleotide
caatgcttcagtgccagtgg

SEQ ID NO: 60 - DNA, 20 bp, Artificial Sequence
  Synthetic oligonucleotide
cagacacagtttcaatggcc

SEQ ID NO: 61 - DNA, 20 bp, Artificial Sequence
  Synthetic oligonucleotide
ttaagtggtgcctcagacac

SEQ ID NO: 62 - DNA, 20 bp, Artificial Sequence
  Synthetic oligonucleotide
ttcagctgcttcaggtccag

SEQ ID NO: 63 - DNA, 20 bp, Artificial Sequence
  Synthetic oligonucleotide
gtgtggaagtcttgatcacc

SEQ ID NO: 64 - DNA, 20 bp, Artificial Sequence
  Synthetic oligonucleotide
tgtaggagaagagagggtca

SEQ ID NO: 65 - DNA, 20 bp, Artificial Sequence
  Synthetic oligonucleotide
cctgggagatggcacccagc

SEQ ID NO: 66 - DNA, 20 bp, Artificial Sequence
  Synthetic oligonucleotide
ttcacagttgctaccacacc

SEQ ID NO: 67 - DNA, 20 bp, Artificial Sequence
  Synthetic oligonucleotide
gccagtggagggtgccccag

SEQ ID NO: 68 - DNA, 20 bp, Artificial Sequence
  Synthetic oligonucleotide
ttcttggtgccagtggaggg

SEQ ID NO: 69 - DNA, 20 bp, Artificial Sequence
  Synthetic oligonucleotide
gggtgtagatgtcagcttcc

SEQ ID NO: 70 - DNA, 20 bp, Artificial Sequence
  Synthetic oligonucleotide
aggccaatgggatgtgacca

SEQ ID NO: 71 - DNA, 20 bp, Artificial Sequence
  Synthetic oligonucleotide
tgtagtcattgatgatggtc

SEQ ID NO: 72 - DNA, 20 bp, Artificial Sequence
  Synthetic oligonucleotide
gaggtgatgtagtcattgat

SEQ ID NO: 73 - DNA, 20 bp, Artificial Sequence
  Synthetic oligonucleotide
cagacccctcagcatgtcag

SEQ ID NO: 74 - DNA, 20 bp, Artificial Sequence
  Synthetic oligonucleotide
tgtggcacttgggacaggtc

SEQ ID NO: 75 - DNA, 20 bp, Artificial Sequence
  Synthetic oligonucleotide
agatgtggcagttggtttag

SEQ ID NO: 76 - DNA, 20 bp, Artificial Sequence
  Synthetic oligonucleotide
tggaggtggacctcaggacc

SEQ ID NO: 77 - DNA, 20 bp, Artificial Sequence
  Synthetic oligonucleotide
tcaagggtgccaccaagtgg

SEQ ID NO: 78 - DNA, 20 bp, Artificial Sequence
  Synthetic oligonucleotide
aagggtttactttgagtctt

SEQ ID NO: 79 - DNA, 20 bp, Artificial Sequence
  Synthetic oligonucleotide
atggaaaagggtttactttg

SEQ ID NO: 80 - DNA, 20 bp, Artificial Sequence
  Synthetic oligonucleotide
ttcctggatggaaaagggtt

SEQ ID NO: 81 - DNA, 20 bp, Artificial Sequence
  Synthetic oligonucleotide
aggtttggagagccccttgt

SEQ ID NO: 82 - DNA, 20 bp, Artificial Sequence
  Synthetic oligonucleotide
ttccagaggtttggagagcc

SEQ ID NO: 83 - DNA, 20 bp, Artificial Sequence
  Synthetic oligonucleotide
gctgagccagggtgaccacc

SEQ ID NO: 84 - DNA, 20 bp, Artificial Sequence
  Synthetic oligonucleotide
gaagatccagcacagggcag

SEQ ID NO: 85 - DNA, 20 bp, Artificial Sequence
  Synthetic oligonucleotide
gacacaggctcaatggcatc

SEQ ID NO: 86 - DNA, 20 bp, Artificial Sequence
  Synthetic oligonucleotide
atacagcagtgggtacacag

SEQ ID NO: 87 - DNA, 20 bp, Artificial Sequence
  Synthetic oligonucleotide
tggctggtgttgcctggaga

SEQ ID NO: 88 - DNA, 20 bp, Artificial Sequence
  Synthetic oligonucleotide
agccccatgttggtgctggc

SEQ ID NO: 89 - DNA, 20 bp, Artificial Sequence
  Synthetic oligonucleotide
tttacccatgagtgcctttc

SEQ ID NO: 90 - DNA, 20 bp, Artificial Sequence
  Synthetic oligonucleotide
agagggttaaaagcattggc

SEQ ID NO: 91 - DNA, 20 bp, Artificial Sequence
  Synthetic oligonucleotide
ctggcattcagagggttaaa

SEQ ID NO: 92 - DNA, 20 bp, Artificial Sequence
  Synthetic oligonucleotide
tggttatgggcatagcagca

SEQ ID NO: 93 - DNA, 20 bp, Artificial Sequence
  Synthetic oligonucleotide
ggtctgccagagaccttggc

SEQ ID NO: 94 - DNA, 20 bp, Artificial Sequence
  Synthetic oligonucleotide
gttaaggctttagacaggca

SEQ ID NO: 95 - DNA, 20 bp, Artificial Sequence
  Synthetic oligonucleotide
gggagtcttagttaaggctt

SEQ ID NO: 96 - DNA, 20 bp, Artificial Sequence
  Synthetic oligonucleotide
agcaccaggtaaacatcccc

SEQ ID NO: 97 - DNA, 20 bp, Artificial Sequence
  Synthetic oligonucleotide
ttagactttggttccaaatg

SEQ ID NO: 98 - DNA, 20 bp, Artificial Sequence
  Synthetic oligonucleotide
tgacagcattagggcaggat

SEQ ID NO: 99 - DNA, 20 bp, Artificial Sequence
  Synthetic oligonucleotide
cagccaggccccttgtgtca

SEQ ID NO: 100 - DNA, 20 bp, Artificial Sequence
  Synthetic oligonucleotide
aggtatcaaaaatataccct

SEQ ID NO: 101 - DNA, 20 bp, Artificial Sequence
  Synthetic oligonucleotide
taggtagagaccaaagcaca

SEQ ID NO: 102 - DNA, 20 bp, Artificial Sequence
  Synthetic oligonucleotide
tgctttttaattggaacaac

SEQ ID NO: 103 - DNA, 20 bp, Artificial Sequence
  Synthetic oligonucleotide
tcagttcccagagcagagag

SEQ ID NO: 104 - DNA, 20 bp, Artificial Sequence
  Synthetic oligonucleotide
ttcagccaagatgtaaccac

SEQ ID NO: 105 - DNA, 20 bp, Artificial Sequence
  Synthetic oligonucleotide
aggaagttatgtgacccaaa

SEQ ID NO: 106 - DNA, 20 bp, Artificial Sequence
  Synthetic oligonucleotide
agccaaagccatccaatgag

SEQ ID NO: 107 - DNA, 20 bp, Artificial Sequence
  Synthetic oligonucleotide
tggcccagagagcagaatgg

SEQ ID NO: 108 - DNA, 20 bp, Artificial Sequence
  Synthetic oligonucleotide
ccatggtaggcagggccacc

SEQ ID NO: 109 - DNA, 20 bp, Artificial Sequence
  Synthetic oligonucleotide
cacaccataagggaggtacc

SEQ ID NO: 110 - DNA, 20 bp, Artificial Sequence
  Synthetic oligonucleotide
tacaggcccaggacacccac

SEQ ID NO: 111 - DNA, 20 bp, Artificial Sequence
  Synthetic oligonucleotide
ggacacacaggagggttacc

SEQ ID NO: 112 - DNA, 20 bp, Artificial Sequence
  Synthetic oligonucleotide
ttggtaagaaaggcatggcc

SEQ ID NO: 113 - DNA, 20 bp, Artificial Sequence
  Synthetic oligonucleotide
tagacaggcagaatgccagc

SEQ ID NO: 114 - DNA, 20 bp, Artificial Sequence
  Synthetic oligonucleotide
gtccatgttctggatcagct

SEQ ID NO: 115 - DNA, 20 bp, Artificial Sequence
  Synthetic oligonucleotide
cagccccatggtgagagggc

SEQ ID NO: 116 - DNA, 20 bp, Artificial Sequence
  Synthetic oligonucleotide
gagcaccaggtaaacatccc

SEQ ID NO: 117 - DNA, 20 bp, Artificial Sequence
  Synthetic oligonucleotide
agtccattttgcccaaggaa

SEQ ID NO: 118 - DNA, 20 bp, Artificial Sequence
  Synthetic oligonucleotide
ccaccaagccacaagaaatc

SEQ ID NO: 119 - DNA, 20 bp, Artificial Sequence
  Synthetic oligonucleotide
cccatgttccaggaggcatc

SEQ ID NO: 120 - DNA, 8544 bp, Mus musculus
ctcgagcccgatccgccgtagcccggcgccagcgcccggtgccgccgccgggaggcacctgtgacgaggtcacctgccagcagatgaccgagaccagcccttagtcctaggtgtggtcaagagtgtcttggctccaaagcctacctggaccctaccaccatgtcaggatccacacagcctgtggcacagacatggcgggctgctgagccccgctacccaccccatggcatctcctacccggtgcagatagcccggtcccacacggacgtggggctgcttgagtaccaacaccacccccgtgactacacctcacacctgtcacccggttccatcatccagccacagaggaggcggccctcactgctgtcagagttccagcctgggagtgaacggtctcaggagctccacctgcgccctgagtcccgcacgttcctgcctgagctgggcaagcccgacatagaattcaccgagagcaagcgcccccgcctggagctactacccgataccctgctgcgcccatcacccctgctggccactgggcagccgagtgggtctgaagaccttaccaaggaccgtagcctggcaggcaagctggagcctgtgtcacctcccagtcccccgcacgctgaccctgagctagagctggcgccatctcgactgtccaaggaggagctgatccagaacagattggaccgcgtggaccgtgagatcaccatggtagagcagcagatctccaagctgaagaagaagcagcaacagttggaggaggaggccgccaagccgcccgaacccgagaagcctgtgtcgccaccacccatagaatcaaagcaccgaagcctggtccagatcatctacgatgagaaccggaagaaagccgaagccgcacaccggatcctagaaggcctggggccccaggtggagctgcctctgtacaaccagccgtctgacacacgccagtaccatgaaaacatcaaaataaaccaggcgatgcggaagaagctgatcttgtactttaagcggaggaaccacgcgcgcaagcagtgggaacagcgcttctgccagcgctatgaccagctcatggaggcgtgggagaagaaggtagagcgcatagagaacaatccgcgaaggagggccaaggagagcaaggtgagggagtactacgagaaacagttcccggagatccgcaagcagcgggagctgcaggagcgcatgcagagcagggtgggccagcgtggcagtgggctctccatgtcggctgcccgcagtgagcatgaggtttctgagatcattgatggcttgtctgagcaggagaacctggagaagcagatgcgccagctggccgtgatccgccatgttgtacgacgcgaccagcagaggatcaagttcatcaacatgaatggactcatggatgaccccatgaaggtctacaaggaccgtcaggttaccaacatgtggagcgagcaggagagggacaccttccgtgagaagtttatgcagcaccctaagaactttggcctgattgcctcattcctggagagaaagacggtcgctgagtgtgtcctctattactacctgaccaagaagaatgaaaattacaagagcttggtgaggcggagctatcggcgccgtggcaagagccagcagcagcagcagcagcaacaacagcagcagcagcagcagatggcacggagcagccaggaggagaaggaggagaaggagaaggagaaggaggccgacaaggaggaagagaagcaggatgcggagaacgagaaggaagaactcagcaaggagaagacagacgacacttctggcgaggacaacgatgagaaagaggccgtggcctccaaaggccgcaaaactgccaacagccaaggccgccgcaaaggccgtatcacgcgctccatggccaacgaggccaaccatgaggagacagccaccccacagcaaagttcagagctggcttccatggagatgaacgagagttctcgctggactgaggaagagatggagacagcaaagaaaggcctcctggaacatgggaggaactggtcagccattgcccgcatggtgggctccaagaccgtgtcccagtgtaagaacttctacttcaactacaagaagaggcagaacctggacgaaatccttcagcagcacaagctaaagatggagaaggagaggaacgctcggaggaagaagaagaagaccccagctgcggcgagcgaggagacagccttcccacctgccgctgaggacgaagagatggaagcatcaggcgcaagtgccaatgaggaagagctggcggaggaggcagaagcctcacaggcctctgggaatgaggttcccagagttggggagtgcagtggcccagctgctgtcaacaacagctctgatactgagagtgtcccatccccgcgttcagaagccacgaaggacactgggcctaaacccactggcactgaagcattgcccgctgccacccagccacctgttcctcctccagaagaaccggcagcagcccctgctgagccctccccagtccctgatgccagtggcccaccatccccagagccttccccatcacctgccgcacccccggctactgtggacaaggatgaacaagaagccccggctgctccagctccccagacagaagatgccaaggagcagaagtctgaggccgaggagatcgatgtgggaaagccagaggagcccgaggcctctgaggagcccccggagagtgtaaagagtgaccacaaggaggagaccgaggaagagcctgaagacaaagccaagggcacagaggccattgaaactgtgtctgaggcaccacttaaggtggaggaggctggtagcaaggcagctgtgaccaagggttccagctcaggtgccacccaggacagtgactccagtgccacctgcagtgccgatgaggtggacgaacccgaaggaggtgacaagggcaggctgctgtcaccaaggcccagcctcctcaccccggctggagatccccgggccagtacctcgccccagaagccgctggacctgaagcagctgaagcagcgagcagccgccatcccccctatcgtcaccaaggtccatgagcccccccgggaggacacagtacccccaaagccagttccccctgtgcctccacccacgcagcacctacagccagagggtgacgtgtctcagcagtcgggaggaagtccacgtggcaagtcccgcagcccagtgcctcctgccgagaaagaggcagagaaacccgcattctttccggctttcccaactgagggccaaagctaccgactgagcccccacgctggtcatcggctgccttcccatcctccacgggaggtgatcaagacttccacacgcgctgaccctctcttctcctacacaccccccggtcacccgctgcctctgggcctccacgatagtgcccggcccgtcctgccacgtccccccatctctaaccccccacccctcatctcctctgccaagcatcccggcgtacttgagaggcagctgggtgccatctcccaggggatgtcagtccagcttcgtgtgcctcactcagagcatgccaagcccatgggccctctcaccatggagctgccccttgccgtggaccctaagaagctggggacagcactggctccgccaccagtggaagcatcaccaagggcctcccagtacccgggctgcagacggccccagctacagaggctctatcacccacgcacgcccgcagacgtcctctacaagggtaccatcagcaggatcgtcggtgaggacagcccaagtcgccttgaccgggcacgagaggacaccctgcccaagggccatgtcatctatgagggcaagaaaggccacgtcctatcctatgaaggtggtatgtccgtgtcacagtgctctaaggaggatggaaggagcagctcgggcccaccccatgagactgccgcccctaaacgcacctatgacatgatggagggccgtgtaggcaggactgtcacctcagccagcatagagggactcatgggccgcgccatccctgagcagcacagcccccacctcaaggagcagcatcacatccgaggctccatcacgcaaggcatcccgaggtcctatgtggaggcgcaggaggactacttacggcgggaggccaagctcttgaagcgagaagggacaccacctcccccaccaccacctcgggacctgactgagacctacaagccccggcccctggaccctctgggtcccctgaagctgaagccgactcacgagggtgtggtagcaactgtgaaggaggcgggccgctctatccatgagatcccgagagaggagctgcgccgcacacctgagctacccctggcaccacggcctctgaaggagggttccatcacccagggcaccccactcaagtacgactctggggcaccctccactggcaccaagaaacacgacgtgcgctccatcatcggcagccccggccggcctttccctgccctgcacccgctggacataatggctgacgcccgggcactggagcgtgcctgctatgaagagagtctgaagagccggtcagggaccagcagtggtgcagggggctccatcacacgtggggctccagtcgtcgtgcctgaactgggcaagccacggcaaagcccactgacttacgaagaccacggggcacccttcaccagtcacctgccacgtggctcccctgtgaccacgagggagcccacgccacgccttcaggaaggcagcctcctatccagcaaggcgtcccaggaccggaagctgacatctacaccccgggagatcgccaagtccccacacagcactgtgcccgagcaccaccctcaccccatctccccctatgagcacttgctccggggcgtgactggtgtggacctgtaccgtggtcacatcccattggcctttgaccccacctccataccccgagggatccctctggaagcagcagccgcagcctactacctgccccggcacttggcccccagccccacctacccacacctgtacccaccttacctcatccgcggctaccctgacacggcggccctggagaaccgccagaccatcatcaatgactacatcacctcgcagcagatgcaccacaacgctgcctccgccatggcccagcgtgctgacatgctgaggggtctgtcaccgcgagagtcctcgctggccctcaattattccgctggcccaagaggcattatcgacctgtcccaagtgccacacctgcccgtgctggtgccaccaacgccaggcacccctgccaccgccatcgaccgccttgcctacctccccactgcgcccccacccttcagcagccgccacagtagctcaccgctgtccccaggaggccccactcacctagctaaaccaactgccacatcttcatcggagcgggaacgggaacgtgagcgggaacgagacaagtccatcctcacgtctaccactacagtggagcatgcacccatctggagacctggtacggagcagagcagcggggctgggggcagcagccgccccgcctcccacacccaccagcactcgcccatctccccccggacccaggacgccttgcagcagaggcccagtgtgctgcacaacacgagcatgaagggcgtggtcacctccgtggaacccggcacgcccacggtcctgaggtccacctccacctcttcgcctgtccgcccagctgccacattcccacctgccacccactgcccacttggtggcacccttgaaggggtctaccctaccctcatggagcccgtcctgttacccaaggagacctctcgggtcgcccggcccgagcggccccgtgtggacggtggccatgccttcctcaccaaacccccggcccgggagcccgcctcctcacccagcaagagctccgagccccgatccctagcaccccccagctccagccacacagccatcgcccgcaccccagcaaagagccttgcaccccaccatgccagtccggacccgccggggcccacctcggcctcagatctgcaccgagaaaagactcaaagtaaacccttttccatccaggaattggaactccgttctctgggttaccacagtggagctggctacagccccgatggggtggagcccatcagcccggtgagctcccccagcctgacccacgacaaggggctctccaaacctctggaagagctagagaagagccacttggaaggggagctgcggcacaagcagccaggccccatgaagctcagcgcggaggctgcccatctcccacatctgcggccactgcccgagagccagccctcatccagcccactcctccagactgccccaggcatcaaaggtcaccagagggtggtcaccctggctcagcacatcagcgaggtcattacgcaggactacacccggcaccacccgcagcagctcagtggcccccttcccgcccctctctactcctttcccggagccagctgccctgtgctggatcttcgccgcccacccagtgacctctacctcccaccccccgaccatggcaccccagcccggggatccccccacagtgaagggggcaaaaggtccccagaacccagcaaaacatcggtcctgggcagcagtgaggatgccattgagcctgtgtccccaccagagggcatgactgagccaggacatgctcggagcgctgtgtacccactgctgtatcgagacggggaacagggcgagcccaggatgggctctaagtctccaggcaacaccagccagccgccagccttcttcagtaagctgactgagagcaactccgccatggtgaagtcgaagaagcaggagatcaacaagaaactcaacacccacaaccggaacgagccagaatacaatattggccagcctgggacggaaatcttcaacatgcccgccatcactggagcaggccttatgacctgtagaagccaggcggtgcaagaacacgccagcaccaacatggggctagaggccattattagaaaggcactcatgggtaaatatgatcagtgggaagagcccccgccgctcggcgccaatgcttttaaccctctgaatgccagcgccagtctgcccgctgctgctatgcccataaccactgctgacggacggagtgaccacgcactcacctcgccaggtggaggtgggaaagccaaggtctctggcagacctagcagccgaaaagccaagtcgccagcaccaggcctagcgtccggagaccgacccccttctgtctcctcagtacactcagagggggactgcaatcgccgaacaccactcaccaaccgtgtgtgggaggaccggccctcatctgcagggtccacgccattcccctacaaccctttgattatgaggctacaggcaggtgtcatggcctccccgcccccacctggccttgcggcaggcagcgggcccctagctggtccccaccacgcctgggatgaggagcccaagccactgctgtgttcacagtatgagacactctcggacagcgagtgaccacggattgggggggagcggtgccaggtcccgcacaaggcagaagcagcccagcatggagcagacagctgctgactccggagactgaggaaggagcccctgagtctgcctgccgtccatccgtccgtccgtccactcatctgtccatccagagctggcatcctgcctgtctaaagccttaactaagactcccaccccgggctggccctgcgcagtgaccttacactcaggggatgtttacctggtgctcgagaggggagtggacaggaggggagggacagcgggccaggaggggggggacagcaatcgtgtgtcagtcgcactcgtgcatctggggtcagcggggacccaccacaggctgaccaggcacctccatgccaccgcctcgccccttaccgcatttggaaccaaagtctaactgaactctcgcgtggtcctgcccctctctctgcccccagcccgcttgcctctggacagacagacgttcccagcttatcctgccctaatgctgtcatcatcgcagtctccaaaggccacccagcccacaagactgggagcccatcagaccaggtgggtgacacaaggggcctggctggggcacggatgcttgcaggaactggaccgtttcccggcctgttgctgtggcaacgggagggaaggcacgtgtaaatggtgttggcttacagggtatatttttgataccttcaatgagttaattcagacgtctcacacaaggaaggactcgcccgtgtttctcccgctgtgctttggtctctacctactgtttcagaggcacgtgccagccaaggcggtggcccaccatacgcaggacttgggggtcaggggctccggcacacggcactgtgcccttccccacaccttacttcagcgaaatggacttgatgcgtattctgtggccgctctctgtgcacggcggcattctgtcatttacacatgttgttccaattaaaaagcaaatatactcaagtgaaaaaa

SEQ ID NO: 121 - DNA, 165001 bp, Mus musculus
ggatagtgtaggtccagcttagctgatgtttcttgctgccagtctgtctacagcctgtgagggagcacccattagaaatttgtggccgggggatttgggcagggcaggttatttctcgggtctaggtctactcttgggtcatgtggaatcgacactggactcccgccaccactttgggatgaagctccagggtcactgtggggagtgtctgtcctttcctgtggctcaggaggacagggctgcacagtttatagcaggaaactgagaaagaagccagccagccagtcttctttagtgcaatactttcctctggcctcagtggctttgccttatagagacttgggtggagaagctgccaaggcttccatgtgaccctggtctttgtctgaaagcatagcatacccgatggcggctgcccccccccccccccccccccccccgccaccagtgactgaggttggcaaaagccggggagtcagaagacaccccaactctttctccataagagagaaatctgaacctatgcaaatgagggagtgtccctagatgactccaggggaccagtaggcaggctggagagagaggctagccttgtctcttccctcccgtaggactatctagccggccttctgcaggtctggttttgagccctcacattgccagccgggcagccgaagagtgggtgcaacgccatgggtgtgtgcccctgacctctgactccagttccaaagggcacccgccccctcgtacacttcctttttttttttttttttcccactcttggactcggttccccctccactatctgccccacacccggactcaaaagctcaggggtggggagagggaaccggcggcatgggtgcaggaaccccagtacccctgaggaagaggcccttgccctggcaaccgcactcccgccgcagccataccgccccccctccctaggggttctcttgttggcagaaccgaatctgctgagacttcactccaaaaaaggaaagttaaattaaaaaaaaaaatcaaactctccaacgcgtctagggaaagcagaagaggagggaggcggcggctgcagggctgggttcccttgcttggctgctgttaaagatctaaggcagagagggcccactatggggcatgtgaatgagctctactgctagtgggcaagctcctactggggttgagtggtcctgattgggtgtccaagactggaccatgggctcagaacgtagcctaggcacgtgtcctggaaaattccctatggctgttcattttagatatcagggggcccgggtgacagggctgcgtagcgcgactcgcgtgggcctctccaggatctcatattgcagtccctgaaccagctcgtcattggttgtggtccgcagagcctttccccaatctcccaggcgaggcccagcgcgtcgctgagcatctgcgtgcgactctgagggctccgtgggtggccctcccggggcgtcgtctccgcatcccctggacactcctgagttataatttaatagctgaaacgcgattcccgtgaagtctctggggttcgcggaggaggagggggcgaggaggtatttgctccgccttcttcgggcaaaaaaaaaaaaaaaaaaaaaaaaaaaaacgcagctcggggtgcgcgcacggcggcggggtgcgtaggcctggaaggcgtgcatgcgggccctttaaggcggcaggggcgggcttccacaaggccccgcccctcgccccgcccctcgccgccaggagcggagccgcgggcagcgcaggccgggccgcatccccgtccccgcgccagccgcccgcgcccgccatgcgcgccccgcagcggcccgcgcgtccgggccccgcgtcgtagcgcggcgggcggagaccgcaggctctcagcccggacccgccgcatcctcgagcccgatcggcgccgtagcccggcgccagcgcccggtgccgccgccggcgaggtgagtcgggccgagtgcgcggagggcggcggggagcgggtggcttccgggccggggcggcgcacgcggcggagttggcgcccccgaggggacgggcggcgcggcagggagcgcgcgggggcgcgggaacttcgggaactctcgggaccttgcagggcggtgcaggccgcgaccctggcacccgggaccctgaaggatggaacaggccaagacttagggacctgcggggtggagcaggccgagaatcggggaccttgcgggatggaacaggccgagaaccggggaccctccaggccaggaaccgggtacctcctgggtggcgcagcctgaagacctggggaccatgtagggtggcacaacctgaggactggtagccctgcagggaatcacaggccgggaccagggatcctctgggataaagtagccccggacctggagactctttagggtggtagaagccaggacccggggaccttctgagatggcacgagctaagacccgggaaccctgcagggagattcaggtcaggacccgagagctctgcttgcagtttaggccaggacccggctaccctgtggtatgttttgaaggccaggccccggggatcttgcagcagggtggcgcagcctgaggattgactgatgtactcttgttttggagagggccaggactcatggaccctctgttgtggcgcagcctgagaaccgggattctcaggggtgggtggcgcagctctaggacttgggaccccctcccggccgcttcccccggcgactctggggtggcacaggccaggatctgagaccctcgggggtggcgcattctggggacccaaggaccccgtgggcggccgcgccccccctccggtgacgcggcgccgcctcctgtaccctccccctggccgtgcggatacttcggatgccactagtttgggaagttgcagatccgagcctagcggggcagccgggagccccagcacccccagacgcgcgtgggaagcggcctcccctcccgaccttgagggaggagagccgggcgggcgtccagacaggcggtccctcgggcctctagagctggaggcgcccagcagcggcggctgaataatctttacattgtagctttattcgcacagctaggtccatccggcggcgtgcgcgcgcgccctccccgagagtctggtgcaggcagcgggggcggatccgttcgttctcagcctcctcccttcctctccttctcctcccccctgttggtgagaactggttttattacgattacggctttttttcctccctctttgcagattttgtggagggatgtgtgagaggggaggtaggagtggaaggcataggatccctgggggggccctgtgggcagtgttagggtggccttggctttgcccttttgattccagcgctggtccctgcggctgctttgatgaaaggggctctgaggccaggcgcgtgtagggggtgcatctcaggccactgctggggacttcgtgggtggcctctttttcttttttaattgtagaggagggggcagaatagtcaaggaggcgaggtggctagaggcctaagcgttctggttggttctgtagctcagctcctgggttcgaatcttgggtggctgactgatggggagttggggtgggggggcagatgacttcacctgcctgtggttatgggcttcttttctgcagagtgagggtgaaaacagttccctggtctggggcgcttctgagaaccaagtctgtgcagagggtccttggataggttactatgactactgttatttccggattctcatccttgctctgtcgtcgtattggggaaacccacgagagtgagtgtctgctccacctttgggagcagggagggtctgatggaggaggcaggatggagaagggccaggcctcagcccattgagcacaggcaaacacggagttggcagccagctgagctgcagtgagtggtggagggggtggtgagggcatttcgggtactgcctagcttccctgcactccatgtccctgttcggaaatttaccgctgtttctttggggcgccaggggagcctgcggtgttcgagtccagacgtgggggtgggagtgagtggccagacctagcctcttcccacggagctatttacgcttgcccaggaatcgatactattgataaactcatgtcggtggtaatgtggctgtcaggcccgggtgagggatggagaccccctcctggggctgtgctcccccccccccccatgagggttcatggcttaatcctttcttttctcctagtgaatacttgggctacctcccaaaggttttccagctctgcaaacaggaaccgagctgcaatacagctggatctagaattgttctgggccagcaggtgcttgccactctacagccccccctctccacagggacccgggattcctggctggaaatgtttctggctgggtcccaccccaaactggtgttggggaacgacccctgtgttaaccgctgaagatgggggtggcacctcctcaccacccagttaaaaggggagattgatccagtgggagattcacacaggctgatcaccaggggctggctcgattttttttttctttttcctcttgtctgaggttcccccccccccccccccccgtctgtctgtctgtctctctctctctgttctgtatccgttcatgtctccgataccatatagcagcctccctaggtgatacctcagggacagtttcctgcaagggtggcagctttctggagctagtgattcccacttaaggtgcccaggggatggatgagtgtgtgtgtgtgtgtgtgtgtgtggtaggcaggcaggcaggcaggcagttagctgtctggggaaggcagagctacacaaagccaagtggagtgggtggcttagaagacccacctctttagggaggaagagaagcttgggaagggtcaggtgagcatccttaggggaggctgatggatgggaaatccactttatggcacgccaggtgaatcctgttctcggagttggcggatctgcatctgcactgcagtagcaaaacggtgacatccaggaaaaacaaaaaacaaaaaaacccaaaaaaatgctgactatgtgctatcattcagaaagcacttactgtgtgtgtgccgacctcagaaagcattcaactgtgtgtgtgtgtgtgccagcattcagaaagtgcctttgtctgtgcaccgagcatctactggtctgttctgaggtgggctatggggaagtgactgtcctattttatagaaggtgtcacaggggccctgggaggttttggtgactggccttggaagctggggcaaacgcctgggttgtttcgcggatcacacagcacgacagccttggctgcaaggaagggatcaggaactgaccttcctcttggggttggcacctgcccatctttgcagggctgtgggggagggcagctcagagactgggaacttgttctcccagggtttggagagggggtggtgccagcggcaggctggcatttctttgaagtctcattttatctcaaaacactcatgcaaatttttggcatctgccttggcgacagtgctgtgtttattttgaaatgaaaacaggggtttgaattatttagcatggtgtctaacagggcataacgctggaagcggggagccctgaagcctggagtgccctgctcctgtctccccggggaatctggctggggacacataagcctgtggttggagaggcccttgctcctgagagccacacaggtcagaggggcagttggcccaaggtcacagcaggacagtgtgcccgtggtggcagtgagtggaagagagatttctcctagtgacacctctgtgttagagcagagtgcagccactgcacattgccttgctcatggacccttagctggtcataaccttttggttcatagataccacaagaattcgtggaagcacagcaggggaccgagtgcctgatccactctgtctgacctggtggttgatttagcatcaaagactaaggttttctgggtcacaagcagtgtgcccaggctggtaacctctaaatagggacttgtgggcctcacctgtcaagttggaaccctgccctcctccgctaggaccccttgggggcttggtcctcagcaacagtccatctgtttcttaaatgctggcccacagcatcaagttgttggatactggggaggttacctaacccctctctctgagccttagtttgctcatctgtgagatggggccacctgctgccactgctgcttgggcacttagcattatgtgggtcacacaagtccatgtgtggcttcgaatcttctgtcaccatatgtaggtagcttccccattagagggcaaagacctgatggaagagtggaagagtttgtcacggggactcgtgtgtccttgcatttgctctgggtggtcagactggatacatttctctagtcttttttccttacttttttttatttatttatttatttatttatttattatatgtaagtacactgtagctgtcctcagacactccagaagagggcgtcagatctcgttacggatggttgtgagccaccatgtggttgctgggatttgaacttcggaccttcggaagagcagtcgggtgctcttacccactgagccatctcaccagcccttttccttacttttttaaaaaaaaaaattttttttggaagtactcgggttcaactatggccttgggtaccactgagttctacacccctagtctggaatcctccctcctgaaggctgcccaagtaggctccccaagtgactggctagcctagtctcttcccttgaccccagggtggagggtgagggctcctcccctctccctggttggtgactctcagctgcttctctctgctctgggaactgaggtttcccctcccacctgtaatcaacctgcctgtaatcaatagcagcttggaatgggctgaaggataaagatggggaatggggccttccggtgtgtttgggggttcccctccctctgtaaccctgacagttgggttgccttagggggtgttttggaaagaccagactgtgacctcctgtgttcctcctctctcccatggtgtcccgagcaccaagctcctgggcaggtggctgtatttaatgttagttggcttaaacagttttagctgctgcctggttgcccctgtgcaccgtggctttggatgtaggagcaaagttggcatcaagcttcatagtcctcccattccgtgggctttccatgctccatgctatcctgaaaggtctacctgtcctgggcatggctccatactcgtccttcccaggccctctgccctatagctttggtatccacctcatgacctcattttcccaccaacctctgatgctgtatgcgaagcccctagggagttagtagcagtgggaacgctctaaagcatcttccgctttgagcctttgctgcgagtgagggtggtacccggacctggaaacattgtaactattgctctggggtttgtagcccttgggagcggatccagggcctcgtgcacgctggctgggtaagttctctctcaactgagccacatgccaagtcttctactttgaccttttattgatgaaagaggctctcacagagttgcccaggctggtcttgaattctgagtcctttctgcctcagcctccagagtagctgagaaaaaatctgctgaatgtaatcatttaattaccaatgaagtgagaagcccgggggcggggatggggtggggtggaggtgggggtgggggtggtagcagtggagcccatagcccggtgggcagtgtggctggagagtctgacaccctggcaggtggtgatttctgtgcacagacttggaccatagctgtgagtctggcagccctgcaaggccaaagacaccccccctccttgttcccccttttcccaggcttagtaggcagctggtgtgagccatgtatgtgtggctttgtctttttgcactgggtggcacatgttgacatagtagctgctgattcagctgggtccctggtgtgtttgcatttccctggtcccctgaggaggacctgcctcctataagcgaaacttcctttctttgctatgaattaatatcctgtggacacctttctctttttataatgtttctcttttggtggtggggggtgcaggctggaagggtctttttcttggtgttctattgctatgtagagacacctctcatgaaagaaagcctttgatttggggcttggggcttgcttccagtttcgaaggttagttgcggatcatcatagtagggactggaacagtagcgggaagctttgcgtcctggtcctgtatgcaacaggcagagagggagggagggggaagaggggagagagagagactgacccatggtgggcctttgaaatctcaaagctcactcccagtgacatacttcctccaacaaggccatgcctcgcagttcttcgcagacagttccactaactggggagcaagcatttaaccatatgaggttatggagtgccattcttattgaaaccaccacaaggtctcactcagtctgcagcccagggcaggcccggaactctcggcgatcctgtctcctgtcctgtgagtgctgggaggacaggcatgtgtcaccacagctggctacctgttcacacagagctgttgttcacgcaaaaaggtccacagcaacaagaacaaatgctttctgaactgcagagggctccgggcttcctagaaaggcactttcataaaaatgatgctggtgtgtataggaaggagggaagacagcagggatgtggaggtgggtaccatttggcagctccctagggttccagtcccaaggctggatgtgtgcaggggctctgagcatgaactactcttccctgtgtccctggggtcccatcgtatatgtgattctattgcacactgattgccgtgtctttgtccatactggtctgtgttctggtacacggtagatttactccagggttcttaaggtgccatccgtggcttgcttcgtgcgcccgggctggtgtgattccaccccccccccccccgggtgtttcttctgcttctcactatgtaaccttggctgatcttgaattcagaggtctgcctctttagtactgggattaagggtgccggcccctatgcctggcctgcatttaaaaaacaaaacaaaacaaaacgattctatgaaatacagccttcagggcccatagatgtgctggatctggctctgaaagtcccgtctacacaggcagagtagagcgtgttggcaggaggtccccaagaaaaaaggtctcccactttgacctttttgtagcctatgtaggtttttgtacctgaggacagaggccctgtgcggggccctggagttcatgttgagtgttcccaagacccttgcttctggcttgagccagtggctgtactgactgttgtattcagtgggaagacgaggtggctgactttgggcacagtccatctgtttcttaaatactggcgccttgtgttgagtgccgagtagcttctgggtgatttgatgtctgtcgtttttcagcattctcactagctttctgtcccgtttccctttgctggcttaggagctctgcaagtctacatgagtctgtgctagggtttttttgttttttgtttttctccccatgtcaccctgggtcaagatttctttgtcttggctcttggcattgattttatcttatcgtggggattcttgagaattacctcagtgctgaggtccaggagggaggtgctgtgtcttgtgtcccctgtgtgcggtggtggtagggagggtgctcttcccacccatgtttcctgggggaaactgaggctgactggggtgtggcttaacaagatcaactttgagtgagcacctgtgggcacctgtctgcctctggcaattaacagaatgactggggggggtgttttaaagcccagagaagaatgtgccctggggtggtgggatgtcacctcttggtggctggggggaccctggagttctgccccgatgctttcagacatctctgcttcctctgacccacttaggtagcactggattggggagggagatgggtgagagccccagggagctcagattagggctgggaacggtgtggggctgtctgtgggtggtggtggtgacccagcatccaggtggtttggcctagatgggttccacggtcaatctctcttgggaaagtagccctggggtcggtctcttggcctgagtggcctcctgggtgaattgttccttggcaggtggccctgggtcagtgtctactgtgccaggtggccagaggatcagtctgtgtcccctttcgccttccccctcaggctggttgtccagttgtcctggggctggtggctgggcccaccttctgtctttgggtgcatttggttttctgtggctcatgtgtgcgttggctccttgaggaagtctatccaagcctagatatggacaagcctgtgtggctggcggggaacttagagcagaggggtgaccttgcagggtgtggcggggtaaaaggagccagggggcttatcctgtagactgacccagctgctccaggcccaggctcatgcacgaaccaggggcattagactccccccacccccacctccccagctgtcttcagggatgacagcttccctagatccgagctggctgaaagacagggatccccttgtttaagtctgggcttttgcttactgtggggctcaggtgggcactggcttgcactagcttccctcgtaccccttcttttgccctgaagccggctgtcacctagctcaaagctcttcccttgaggcagaggaacataaggggaccccacaggttctccccacccccttaatatttgtcttgctcacttccttggactcttggtcttcgactgcttacccttgtgggtagaacctgcattccggttccggaaggtgacatagggctggtgtttgctctgtggtcttgtgtattgaggttctctattgggggctttaagtcttaggtctcagaggctcggcctacagatgtctcatgcccatctgtcttcatgccggcctctacagggcttactgagtcactctgagagaagccctgtgtggcctggtatctccatggtcgtagcaatctgcctggcactcattgggctaatggtgccagcctgctgtgggagagctaagttggctttgggatagtggctcctggatggtccctactgagcctggggagacagaggttgtttgtgtcttcgacttaacctggcacacctttgctgtctccacctgttttctatgcctggaccaggccctggcctgggttggtcagtgtctccttcctattgaagttctccttcaggggaccctaggatgtgtgaccttcagtggtgaggagttactatggtcgtcagtatttaggctgaagtcactctgcagtgacatgtcccctgaatgtagcggtgcccttttaggaggggctgacatgatagacagaggcagaggcgggactgccatggaacgcaagccactgcgaacatggaagggtaaggatgagaaggactcagccctgcccttgagtttggacttcctgctccaaaagcatcaaaagttgtgagcccttgggtaccactccttgccagagtcactctgggaagtagattgtttctcagcagtggccctagtcacccacaccgtaggagacctttaaaatgccagtcacgctgagtgcagtggtgcatgctggaaacctgtactggaaagctgaggcagaaggatcagagattcaaggtccgtctgggctgcgtgatgacgtcctgcttaaacacgcatgcaagcacccacctacccatggctggtgaggtggcccagcaggtaaaggagcctggtggtcctgagcttgatcctagaacccacggagatgtggaagaagagaactcactcaacagaactgtccttaggcttaaacatgcatgctgtgcccacgcccctcacaaaaagacaaaaaagcaaaataactcgggccagggagatggcttcaccagtaatatttgccttgtgagcagggggacctgagttgagaccctaggacctgtataaaaagctggcatggacatgtgagcctccagtggttctcaacctctgagtcatggcccctttgggggcctgaatgctcctcagggggacctgagttgaacctctaggacctgtatagaaagctggcatggacacgtgaacctccagtggttctcaacctgtgagtcatgacccctttgggggcctgaatgctcctctgttacataacagtaacataaattactgttatgtagcaatgaaataattttattggggtaggggtccactacaacatgaggtattaaagggacacagcctaagaaaggttgaaaaccactgctctaatcccagtgtttcggaggcagagccagggttcctgggacttgctggtcagctagcctaacctgattggaagggcctgtgccatggtgtgaggacgcccccttcaaaaaacaaaaaccagggttagacaggatctgaccagcgcttgagatgtcctctgacctccactggcctgtgtacacattcacccacacttagacaaaactgagtcagatcgagccagctggcccagccgcagagccaggcctggctggcaaaggcctgtgtagctgctcactgcccccgctcatgtgcttcctctgtgcctgccatgttgaccttggctgctgctcctcctgtgttcttccaccccagggcctttgcacactctctctgcccgaggtgctttccgctggggcatctctacctttgcttccacattgcctgacccgagggctctttcctggtttgtcagtacctaacaccttcacctggctgagtgagggtgtaatgtgctaggccttgtctgtgctgacctctacagtatgaggctgtctctctcgctgcagtgtgtcaccccactacacctcaagttcttgaatggtgaggctggtacctgccctggtactgctggggatctgagtctcccatctgtcttcatgtctgatacctttgtctggactgcagtgcccgagaccaggcgcactctcctctgaggctgtgactgctctgggcctctgtgcagcagtcctaggtaccagcgagtctcagcgtctggatttgtcaagcaggcagctgccttcaactgtatggcatgcacgtgggtggatgttgtccttgcattcactggcctgcccctgcctggcccttggggacaggtgtgcacactggtgtgatagctgtggcttctgtgccagaagtccactctgccctagtgtcagagctggttggggatattagcaccctattgtgcctgtcctagactggcccttctaagtcttggtcaccagagtccccagttgcccatttttcagatagggaaactgaggcacatagtagtgttactgttacgtcccattctgggtggcaggtggcctgggcaggaacttgtctgtccttgaggtccttacctttgactggctggaaacagtccccgccctcatgtgtctctggtcactgcagcttgttccttcagggccaccctccaaggctgcgtccacagctttggctggctctgcagagtgggaggttgacccctactatcttggcttctccttgccggttataaatagcagctgcagcattgacaggaagctgcattcccccattgtatcccccccaccccaccccactgtgtccctggcacctattgtccttgtcacagcttcgtgggaacacaccaaggcagtcagtattgcaggtttgctgtgtgaccttcaggtctgtgctgccctctctgtgccttgagtcccttgtctgggcatctagggactggaagaggacttctgggggtttgggaagcattgaggtgggtatagccaggagcgaggtgctggcatggggcagggcattgttgatctcaggcaggggaagctgataagttactgctttgggtgggtcttgggcaccagagggccagcacttcctctgttttctagccagaaggtgacagaaaccctttgagacaggagtgtttcacagggccctgggtcagcttgactggctgttgtcattctgtcgttttgatactgccatggggtcctggttccctggtggtccaagggcctgagtatctttgggtggctgtgagaccccacctcccctggctaacagcctctctctccagtcctcattcctgtctgccactcgttctggaagccccacagggcctcaccccgcacacgcctcaccccgcacacggcctcaccccgcacgcgcctcaccccgcacgcgcctcaccccgcacacgcgcctcaccccgcacacgcgcctcaccccgcacacgcgcctcaccccgcacacgcgcctcaccccgcacacgcgcctcaccccgcacacgcgcctcaccccgcacacgcgcctcaccccgcacacggcctcaccccgcacacgcctcaccccgcacacgcctcaccccgcacacggcctcaccccgcacacggcctcaccccgcacgcgcctcaccccgcacgcgcctcaccccgcacacggcctcaccccgcacgcgcctcaccccgctgtccagctataccttgcagagttttgtgacctggcctggtgacacctggaggcttcacagaagatacaggctctgttggtgcttgtattgttcttggcctcagatatgcagatgggggtgaggaggagtccaggtctccatggggaggaacttcctgtgcccctgatcagcctcatgactggacaaaaaaaccaaacaaacaaacccccaaatctccaagagttagttacttaagaatgcagattgctagttaatttgttaacctagggggaggtctgcagtgatggtgtctacctgaatcatattctcataaaaggccagactgtgtgccttgggatgggcctacgtcataggagagacagagccgggcatgccctgtgtgctttgtgggaacagagaggctgagttgcttgaaccccaaaattagatgctagagctcagagttcgtgggtgtggccctgggagttcccctgaggctctgaggtgcttgttttgcagtcctttagaggggaacaacagcccccaaatgatgctgtgttttggaagctgtatgctttgtcaaaggaccaaaggaagccaagactggagatgagacttagggtgagagtcagctggagccaggtgactgttgggggaaatctcaccaatgtgtgcacagggtcttcatgacaaagagactggagaccggggctggaggaggtgaggatcagtgtcctctgtccctggctacagggacgtccagctcggctacgggttgtcttcttgcttggctcttgtgtttcttatcctcaaacggagggtggagatggttttgaccgttgcctggtcatgtcccttgttataaccaaagaagcagctcgttcacagccagtgctcacctagagctggggacacagccgcagagatggttgtctcagacccaggacatcagtggtcgttatgtcctgggatttggggaactggctgtggaacaacaggagagaattacatcttgctagggactcctcctccattggcaaggagtctggtgaagccagggaggctgaaggaggcaggaaggtctgtggttccatgtcctctctttgttttttattccttcaaagctagtgtaactgttcctagcggatggcctgggaacagtgtgaccctagcttatcccgtgacagactacagttggttctccaggatgcaccggctcccccagccgtggccttgtctccaaggggcaggtgccctgggttctctgctgcaggcagtgcccagaggccaactccccaactgcagagaaaggcggaaattgccggctcctgtcccaaggcctctgggcctgtggccaggaactggagcagcaattaaatgaaatgagatccttccatgcaagtgtcatgtctctctctgtgtgtgtgtgtgtgtgtgtgtgtgtgtgtgtgtgtgtgttgggtgcagaggctgcagggcagaagtgggttgtgtctatcagcctggatcaggaggcaaggagatatagggagctatgttggttaagatcacaggactctgcctttaggttccttcactgcaggccagccgggtggggtgcaggcttttcccgcccacatctttctgcttcttctggcccatgtgtttccctgctgggctggtccctctcatgtcctcctggccgagttcacaggtctctgtcattctgcgggaggcaagctgcagcctgctgtcaccgtgagccatgcggtcttgccagtttgtaggtcagcagtgggcgaatggtgacagctttatgtgtcacccagcctagagtctcccatgctcaggatgataggcttcagaccccaggggcactctgggaatcctgcaaccccctccctcctcctactaccatctatatatccttgacatgtttaaatcacgctgcctcagtttccctatgtgtaaaacaggatgaggcagtgttcctcttctcggcttctttgtggaactaggaggatttagaaccaagccactgcctgtaattagcaattgtccccatccttagacctgcagcaagacccatgtcttgtgggttggtgtcatttcttgagtagtgtctgtcgcagaggctgtttcttgggatcataatgggaaggggccattaaatctcccccccccccccgtaccccctaggccccagtatccctattcacagaagagccttgggctgctttgggattcaggtgagtgatcttgcccaggatgtggagtctgggatggcatttggcccctctgcaccagcaggcatcagaagtccttctctgcaggctctgggagcctctctgcacagagccctacggggattaagtgggctcatttgatcgagaccgtgaacttgagcaggcagcttatctcctttgagataaaagctgggtaggccctgagccacctggcctgcggaggaagtgcgggattttatcctcccttctgctagccctgtgaggggcctggggcttccttgccagcatccaggacttttcactgtggactaaagctatagctgtgctcagctaaggaagcttacattgtatctacctatatactgtgtccccatgttttggctgaagtcctgaggtccagggaggttagtggacttggccagtgtgtgtacccggcagcccagcccttgacagtcagtgtttggaagctttggtgcaaagtgggagtggctgggcacagagttcagggaagagaagctgtgtgctttggtgctaaagggcctctgacttcagtgcctgctctgcaggacagctttaatggccgggtcattcaaagcttgtgtggcgtggggacttggatggtgtgggactctcctgggcaaagctacaaccatttctaccagtttctaggagatctagggtcagggtgttgccatggagaccccactgctatgtctctcatgggtaaaaggagtgatgagaccaccactgtaggttgagactgcagccaaactacacacactgtgggtggagaatatttttctattctcagtcactgcaaaggccaggccctaaactagaagccagcccaggtctcctggcctggagcagtcctgccagaggatgatgagggactctagtctttctagactagacctctgggtcctgcccccccccccccccccgcctccatactgccccacccacctagaagcctttccctagagaccaggcgacatcattataataggcgctaggcttgctgtatgactttgcatgaccaaagcaattcttataaagacagcatttaattgggggtggcttacaggttcagaggttcagtcctgttatcatcagggggagaacatggcagcatccaggcaggcttggtacaggaggagctaagacttcatctgaaggcttctagcagaatactgacttccaggcatctaggatgagggtcttaaagcccacaccaacagtgacacacccactctaacaaggccacacccactccaactgggacacacctcgagcccctcccccccccccccccccccccccgcagggtttctttgtgtagccctggctgtcttggaacttactctatagatcaagctggccttgaactcagaaatccagctgcttctgcctcccaagcactaggattaaaggtgagcgctaccaccaaccccacaccttctaatcctgccactccctgagccaggcatatacaagtcatcacacagtttctcactggggcctggactgtcagatgtaggctaggctggctagccagggagtctcagatgtttctccctcccattccaccattggtgaggctataggtgcaagccagcatacctgccctcagggggtgggggtccaaattcaggtctgcacacttcagaagtcagcgctttgcccgcagagccatcttccctgcccctcactgttacttaaagcacatttccttttctcattcgaaaacgtaattatgcgagtggaaaggtggcttagcagttgaaagcactatctgctcttcctgaggatccaggcatggtttccagcactcacatggcagcccacagccacttctaactccagttgcagcagatctgataccttcttctgacctgtcagcaccgtatgcctgtgatgttacccatctatgttcttgtaggcagagcacgcaaacacacaaactgaacgtaaataaatcttaaaaaaaaatacgatgtcattaacctggccacacaatccattattactcagctacaaaacagagtgaaacaccacatcctctacctctaggaactcgacccagagtgacctggaacgaaagagggagcaccggaaggaaggcatgtgtgagctgggggtagaagcatccacatccattaaagtccgatccctggagaacagaggagcggtggggagggtactcagaagacttcagtgttgtggacgtggtcactttagggcagcagaatattctggaactacatagcaatggttgtccagccttgggtgtatcaaacaccattgatttgtttacttttgtaatgactgttccatacatttttgtctcaataaatacatgtaagaactaatgaagtttttgttcatttgttttaatttttaagtgagcatttattacaggggctggagagagagatgttcagcggttcagcgcatttgttgctcttgcagaggactcgggttcaaattccagcacccacatagtggctttcagccatctgtagcttcaattggaaggacccaataccctcttttggtttccacagatattgtcacacacagtggtacacagacctacgtgcaggcaaaacatccgtaaacagatattttgaaagttacctttatttattgtgtctgttgggagagtgagtcatatacataggtcaatggtgcgtatgtggaagtcagaggacacatgggggaatcagttcttaaagctatgtgggtcccaggattgaagcccagtcctcagccttggtggcaagtgcagtaacctcaagcttaagattttattttatgtatgagtgcactgtagctgtcttcagacccaacagaagaggacatcggatctcataatagaaggttgtgagccaccatgtggttgctgggaattgaactcaggacctcaggaaaaaaagagtcagtgctcgtaactgctgagccatctctccagcccacattttctttattaatctacctggttcggcaccttgtagccttgtggcttagcggcactgtaagatgagagacaggatgtcaggccagccagaaaatggtagtggtagaatttgagtttgagcctcaccctctcctaagattaagaattggttccagattgtaaggctccaggcccatcttgctggccagggatgagcttgaccgctgtccttgtgatgggcaggcttcctcgcttgtgtctgggatctggagtcccttggacctggcacacagcctcccagtggttctgggagagtcacagcccaaagcagaaacctatctggaccaggctgtacatcgttcctggtcactcctggagtgcagagtgctgggcctctctttccccttagcccatgtgaccttggcttccaaacacatgctgagcctctaggaatagtgtctcccccaccttggcctccttgagcctcagtttctctgattgtatgatcagcccaagagagagtctgggatcaacatctcagaacacagagcggcaaagctgtggtgtggtgtggcgtggagggtggaggggtgctgagatgttacctcatttggtagtgtggacgcatggaggtgactcagggtaaccccagcttgcagcgagaacagggcagagcatgccgagccagtctcttagggctgatccttactgcaggggtatgagggaattttcctcctggatctgcattgggcaccgtgaggtagacaaccgtggcaggcagtgtcagctcacacaggggactttgtgaatggggagtaggaagggtctgcctcccacacgaccccttccatgccagctgcctcttctatctctggtttcgagactcttgactgtcccctgagccccgggtgacagatctctttaatccgcctcttgacccaggcaattaattgcattctggagatcgatcgtggccctgatctccgccgcagcccctggcccagcacattcagcctctagtagcctgttcctcttccatgggctgagactgggaccctctgcaggaagcctgactttgcctaggcactggattgagcctcctggagcaagcttggtggggattgttggctgttttccgacccaggcctgtgagcagccatgctatgtcctctctgcagatgagccccaagggcagcaccccccatctgctctcctggtctctgccccaccttgttccccaggccaggagtacacagagacagctgggaaggttaagtcctctctgtggggccttgaccctttttcctgtgtcgtcccccccaccctgcgtggaacgtggtaaaatgtgctggcgatgtagtagcttagtggtagggtgcttgctctgacatgcctgggggcctaggttcttctaccctacccctagctgctcagaaaaacaaaactagttacaatagtagtaataataccagagcggcacttgttgggagtgaaggtttgcatggggctgggcccatgtgcgtgatggctgacggacaggtggatagcagatggtgtctcgggttgcctgggcctctgtgggctcccggcccggtttgtcctggcctggccctgtgtttggctgtgagccagacttcctctgaccacagagaggccctttccctgggaaggcggtcggtcgatgcggcttcatcctggcctcggcctctaattgctccctctggttctgccttgtgtagatggtccctcccctcccctcctccccaccccatccccatcctgccctgggtgagaagctagatggcttgtctgagcagccacgtgtatgggtggagggccaggttcccaagtcccgagtgaggatggagtaccgctccccatcccccatttctccctgtccctgtggttctggggctgtgggggggtttatccatttgtggagtcgggaagactgtcactttcctcatagggttgaggagacattacagtggctggtacaaagcccacatggtggctctgggtattgttcccatgatgtcagctccttccccctgctcgcgcccccccccccccatcactgtacccagactgaaggggcctgatgtcttggggagcaggcaggtgtacttggggggcagctctgctttcagtttccctcctgaccttgtgattctcttggtacagcccgtgtcccctcactcttgtcactaaggccctgtcatgtggtgtcccctccaccccatcccacccctgtgctaccagccctcttggccttggtttcacagcccctgccctgctcctgggagggctgcaggggtgaggtggccgccatccgcctcctgccgtggccgtggcagccgagctgctggagctgagaccttggtggcctccctgtgattgcttctctgcagcttcaaggagagccgctgagggcgggcgtctaggctgtcacttgagaaggaaaataaaatgtccccgcggcttctaaatggaagggcggtggagcggcctcctttgcttggctgtctcagctgttggctcccacagtgacacaggcccctgggggacagggtaggcttcctgtttacctggtgtggaaagatgtacccggccgggctatcctgggagggtgggggaatcccccaggtcccacagagctttggggatctggccactccagctttgggtagctgggctgtcttggtccaagtcctcagacagccgtttatataggattgtcatggggctgggacggggtgtggtgtggtgtgtgtgtgtatcacgtgcacgttgagggctggactagatctgtgtctagttaagggcttctgtagaatattgtctctcttgatgttcctgcagttgggtttcgtggctatctagagctgcggggagttcatgtaggggaagatagctcctggtgagcagtgttacttctctaggtatctgtcgggggctgtgtggaagtggagggtcctaagtaggaactgaatgccgggtgccttgctccagacacgggggcaatggtggcctggcttggagtgtgggctgcagggcagggtctgggtcttgcttgtgattgggttccaaggtctctgcccatccacacttcttttatctggggaccaagggtcatctgttctatggagggaaatgactgctggccaggaggaggttggcaggtaatgggcatttgtgccgtgtgccccctggggtcgtcaccaatagatagtttctgtcatctgtcatgggcacagaaactgggaggcacaggcctgcgatggctgggcccttgaggagcacagagctaggtttggctcctgcagcaggcgcacgccttaggtccagagactgtttagctctttctgtggaaggtaacagatggggtcttgagagggcgctgcttcaggtccagagactgccctgggtctgcaggctggccctgtcacctcatgcctgtaacccctaacagtgagagcaggttggtgttccttgtccccttgtgccacgccctctgcaggccctgcagaagctcctgacccgggccttcatagctagctggtccttgagctccttactgcagcccctcccccattgctgagagttcctagggctgcttctcctggtgccctgtggggggtgtggctgtgtcataacagtctaaggtctgacctttctgtgtttatggccacatgtctctgtctctctgtctctgtctttctctctttctctcaatctggcctggagttaggggttcagtcccttttggatgggctattgttttcagggacaacctcttgtcctcctgtaacttgtttctgagctgggccaggggacaattgggtagttccccagaggagaaagaggttggtggttgtcacattcctaggaaggcagggatgggatggggggggggggaacaagttggaggttcagctagtgggccttcctttgaagacagcgctgcctgaggcctgggagaggtgccttggaaagtgtcccctccccccagctgtgttgctgggaactgacttctaaacctcaggggaaggaggggcccttggagcttcctgggccctggaggggggagctgggaaggaggggcaccgcacacccagtgtgtctgctgagtagggagctggcaagggagcactgggtgaaaggagccgtggatgtgcagacatagcttgccaagtgtgcacaggggatgggcggggcaggatggaggggtgtgtgcatgcgtgccacatgtgtgcttctgagcagagtgcctgtgaaggggagccagggtggctgcaagccaaacaggccaactgcgtgcgtgcgtgcgtgcgtgcgtgcgtgcgtgcgtgcgtgcgtgcgtgacattactgatggtggagggaatgagtgagagcaagggagagtgctggaggcttatggtgtgtgcacttgagcagacaggaacccagggagtgctccctgtggcaggagagtgctccccatggcaggagggcaaggccacctgctaggagtattgcacatgggaaccagctgttgtctgtctgggttgtgtgagtgtgtgtgtgtgtgtgtgtgcgcgcgtgcctgcacgcacgcacttgtaagcctgtcatctctttggttatgataaagcacttatactaaaatcaacttgtggaagaaagagtttatttctacttaaactttttggatcacagtccatcattgagggaaatcagggcaataattcaatcaggaactgaagcaaaatccacaagaaatgctgcttgctgggtctcgcttggtcttgctcgtctagcttagctttcttaggctgtctaggctcaactgcctagggaatggtgccacccactgtgtgtccggcctacccacatcagcctttagtcagggcagtctctcacaaacatggccacaggccagtctgatagaagcaattcttcactagaggttacttcttgtaggtgactgtaggatgtcacattgacaataaaacgtaggacaagacctgtgtatgagcagcacccatctatcctagtgccccagtagccctgggcccaggctctactgtatgggggagggtgtgtgtgtgtttgtgcgcgagagtaggctccgtggtcatccagcctcaacctcctacctgagaagctgggacagccacctcaggtaactcagcactgaatgaggggctggggttaccaggccatccctttgtctctttcctgagctgcccacaggcctgctcctagcccatggtgggcagagttgctctagccctctgttggctttgtggggatccatgtgagatgccctccttcgggtccttcagggtcacccacctgctgtctgcttggtggcattccctgttgtcccctacaccttgtgtggttctcaccccttctaactgttctccagtggcatgggaccttgttcctccccagccaagctctgccttaaggcctcgctgctcaggctgaatcccaccagatgtccctgcgtgggtggccatgcctgctctgtccagtgccgtgcatgggacaccaactatccctatgtctcctatgtgtgttcccaccagtttctgccagcatggcagtcttctcccttagcagttctgctggaactccctaaatggggaacacctcccttgggcctgactgctgttcatcacaagtggcccctactgatcttgtacgcacccaggcactgcattgaagaagtcccaggcagtgagggtctgaggggatgatggccttgtttcccagctgatctcccagggtagggcccagggagggagggcacctgccttcaagggctggagttgcctgacccatcacagacaggctgcaggtggctggctgccgaagcttccgggagccatgcccatcctccccactccagcttcccacagggcctgtctctggagttgctgcagatggcaggacccagtgccaagccctggggcatcatggcaaacaaaggcataaggaggacacagggcagaaagaagcaactgcacggtctcctgtgagtcgccggcagctgccccttcaagcctggggtttaaggggcctgccagggcaggcagtgtgggagtgcagggcctggagctgggctgccagctctggattgagtcttggcagtgccagccagcagtcacgggagcacgcaggatgcatgttcagactccttatatactcaattccggcatgtctatgaggtggtttctaccaccgtgaacatttcagagatgtgacatgaacagagaggggtggcttctggcttccaaattgcacagctgggcccctgggctgctgtgcctaagcatgttacacctccaccttcttccttggtctgttatctttggggttctaacatggtttggggctgagatgttggtgcattgggaagtgtcttggagatggttttggggtccagcttgtttctcagggaggaccgagcaaggtcaggaggtactctgtccactgcgctttgtctccagcacatcgttttgccatacagtaaagaacgaatgaatgttgagtggaggttgtagggttgtggttttagcctttggggaggctgaggcaggaggattatgagcctctctgagcatgagcctgtgggtgcaggtcacacagcagacacctacttggctgtgtacagattccattatgtttgctgcggcagcacctgtgagttccagctgcttctggtacacttgacattgtcttaatttcagccaccctggcgggcagttgttgtggctccagacttaatctgcactctggaagcgttgccctgggccaatcactggccattgtcccctttggggcgttaatgtgctgcctttcagatccaggctctctgctgcctcccgctttgcatgatggcttggttaaggactttgtttcttttaacttggcagcactgcactggggaactgaacctaaggcccccatacatgctgggcaggggttctgccacttcgccacgctaccacccctgcccctctttttacattttatttttagacaggatgtcatgaagttgctcaggctgaccttgagctctgtgtagttcactggccttgacctctgatctttctgcctcagccccctgtgtgtgtggtatgacatccctgtgttaccaggcactcttagggagttgggagtataggtggtaaatggacctgcctgacaggtgccaattcacttgcttgtttttggggtcctggagggggagtcgctggggcagagtcatggtcatgatggtcttctaaggtggtccctgtctgggtgtgggcttcttggacccgaatggggttgaggttgaaaactgtcccttcataatgcacgagtttgggttgcctgagcctcggtctaccgctctgtgatgtgtgttaaggtgcctccctcatgggggtcactgagggaagtccttgtccatatgagaagctgtaataagacctccattttttccccccacagtgctcctgagtctttgaggaacacagcctcctggtggaagttcgtggtaggttcatctcttatttctacttgctgtcttgggtgtgtgtgggggtccatgctgcttggatctttgatggaaggtggtgcggagtgttggggaggcagaggctgtctggcaggtgtggagtggtgcttgttacctcagagttgcctaggcatggcggggagcagctggggactgtgactcctcctccccgcccccttcccgccagtgatcttgggagagttctttatctattaatgggttagttgtttgtcatttcctttcttttgtggtagtggggatagaatctaaacctcccacacactagacaagcactaaccactgagccacgcctccagcttttgtctctgtctctcttttatatcgagacagggtctcactaagttcccctggatggtctcgaactcacttcatagatctggttaggctttgagcttgagttcctcctgccgctgggacaacaggcctggctcctggaactcttgacttctttctgaagcacctactgcgtgtaggttgagcagtaggtgactgagagagcatgccaacaagctgggacaagtgtcctgtccttgccagcagtcggcaagcctgacgtgagggaccgttgggtgaagcatgaggccagccgagaacagttacggatgcgtgtgcaggatgaggcatagcttcatgtggagtctcatggaaaatggcatttgaggctggagtgatggctcagtggttaagaacactgggtgctcttccggaggacctggccaactttgtttcctagaccctcagggcagctcaacaccattgctagctctagttccagggtcacctgactccctcttcgggcttccacacacaccagtcacacatgcggtatgcacacagacatgcaggcaaatacacatacacggaaaataaagaagatggcgttggattgaggtcagagaaggttggtgtgtgtgtgtggggggagggctatctaggcagagggcacacacacctctgcaaaggtacagtcttccacggggctagctggctgggactcctctctttgttttgagccccaatagtcaggaggggaggaatgtgtaaccactccccgctcccccagccctgtccagcggggctgtggttcttgcctctcctcttccaggctggcactgaacttatggttcttttgattccgctgtctgtgtgcaatttgatgtgtgtgccgctgcacccggtctgtgtggtatggagggcgaacactgcatgctaggcaaacactccaccaacagagatgcttcttgtagccataggctgtggtttcatctgaggcgggaagggggtgggtaggagtctgtgggggtggggctgcccactgggtctttgagagtggaaagaactgcttggttgctggccccccacccccatccatccgcatctcgcctaatggggagccacctcagcctgacttatctgcctgtcacgccagtggcccacccgaggacgataaaagggctttttgtctgcaagcacttagcttcctccactggggcgatccatcatgcctgtgggaagagggaagcagacagagggggagggccgggagccagggacccaggcagctcctcagccaagacaaggctgtctgggaacagcaggaacagaccagggatgccctgagccccgtccccttgggcagagggccacgaggccttgtggagatccttgtgccttgggaaagtccgctggggggagggagcagaagtctgtgtaacaagccggtcacctgcacacaccctcaggtccctgaccactttgtgggatgaccttatttgatctccagagcactccgaaagtgccatgtcactgtccccgaattacaaatgggggcagtgaggctgggaagtgacatgaggtccgcacaccgctctgcactgatggggttctgtggtgggcccagccatgttgttctgaccttgcagtgggaagagggggccctgggcttttctaggggagggccactggagttttaggcttgggtgggaggtggtgtttacctgagccccagctgagagatgtgctggaagatagagagaggctgataatggggggggaggctggttcgggaacagggcggtcaagagtatggtcaagataggcaggtgagtgcctagggctcactgggcagattctggggctgtggtcagtaagagaggctcacactctgggctctgtttcccacctggagaacagcttgggttttgtcctctaaccctggctgtaaataccacgggtcggaagagcacaagatccccctcccttctctctgggtcaggatccttcatcctttggctccttcccagctctgagtgctgagccctggccagactcctgccttccttccctgccctgccctcctctcccctcccctccgcctctgccctccctcccctccttttcccttcttcccccagggccaccctcaaatgacagcaattaatggtgcctgtgatggcggagtgtgacagctgagctgcctgcctgcagctgccctgctaatcgggcccgggggacccccctcctgctagttctatgcacgcctcccctttgctcactggggctcaagggccagccagcagtgggcccgtgggaggtggcagggttaccccaaccctgcagcttcttccgctggccgtcctcttctgtcattagggcgactgttgcctgaccttgttgtcctccagtgagcgtggctggggcagtgggcaccccaggtgcccacctccctcccatgtcctgttccaggtctgatgctggcctgatgtgaccctcagggtgagccgggagcctttctcacaggcttctgtgcttcctgtctcctgagagggagagagagggttcccgtggaatcagacctttgtcccgcctcagacggacatcatcagtcagactccccggcttcatcctggggacctggaggcagctacttagtcctgcctgttgcctttgccagggttaaggatcccagcatgtccttccatcatttcgaggtggcaataatagggctcctgctgtttaccaggacctgcagccagtgcattcaccttggtttattttagggcttaaaaatatcttgaactctggaggcagaggcaggtggatttctgagttcgaggccagcctggtctacaaagtgagttccaggacagccagggctataaagaaaccctgtctcgaaaaaccaaccaaacaaacaaaaaagtaaaaaatatcttcatattacttgtgtgtgtgtgtccagttagaggacagcttgtgcgagtcagttctctttttcccaggatcgaaatcgggtggtcaggcttttgccgcaagctcctttcctctctgatacattttgtcagctccattttctggtgttttgttttgttttgttttattttttggagatagagtttctctgtgtgacaagccacggctgtcctggaacagcatagtctatagaccaggttggccttgaactctcagagatccacctgcctctgcttcccgagtgctgggattgaaggctcgtaccacaccaggccagtattgttttctggtttttctaaccttgcttttatagatggagaaactgagggagaggagcaaaagtcacttgatagaaatgacttagtaagaaaggcacaaatgtgactttgagtcagaccagtcctacctggtgctcttacatcaggagaatccagaatcctcatggagaagttgggaaatgaagtgggcacgcgcgcgcgcgcgtgcgcacgcacacacacacacacacacacacacacacacacacacacacacacgtaaatatgcattcttgcacagaatgtgcctagcttcgttcctcacatgtgttgattctggtctgctcttgtttctcacacttcctgctcccattctcttcttgccaagggtggttccatctttcagtgtccagccgctcgctgatctggtccccccaagccgtggcttgaagaaagctcccttggaccattccttcctgctggagtctctgtgaacgtggttctgtttctcctgggtgcatttcttgttggagtgggttgagaggtgcgtggtaaatgtggaggagccattgggctgttggacgaagcactgtctcactttgttcccaccagcggggtgtgggcttgtcgctgtagctctgtttctgcgcctgcacttgagactgtcgggtcggctccattggccacccgagtgagttctgtcgtgttttcgatgacacttcaacattggctgcattttgattccctgtctggccagctggcggaaagcttggatgggtgagacagtcacgcacctgccagcactggctctgtcgtttctttgtagtcccaggcgatgacttaagttttccttgtctcacaacgtagaccagggccgtggtgtgttgttgagtagcggcttccagggttaccaagcggtgtctgttctgaacatttctagttaacagaggaggaaactgaggcacagagagtccaggtgatttctcccacaggaggataattggcagtcagaactacagcttgcacactttctcctctgtgtcagaaagttctgactccgggtgttacaaggatgtgtttgctgagctgagctgagctgagctgagctgagctgagctgagtggagggttgtgccaagaattgatggccaggcagggccagaactcagccttccctccggggtttcctttgcttcagagccaagggtgtggaggagagcccaggcctccgggtgaagccctgtcctctggcacccagtactgtgaagtgagtgtcaagccgtggtctgccaaggggctgccctcatcgagcctgttatcttgagcaaaatcacagaagagttctggggagctgttgtggggcaaggtaggggccagctactcagaagtccaggaaagggggtggcgacggcagaggagggcctccccaccctttacaacaccccccttccttgcctgagggggtgtcagctaagacgacttttcaggggaagaaggcccataaatcaaataagcaatcccgtaaataaataagtaatgaagttagtggggtgcctaattacatcagagtcgtaattacggatggatgcctgcccgataattgtacttgtttttattctttggctccgacttgtgtctcctccaggcagaggaggcgctgtttcggggcctttgtgggcctagtggttgggtatgtgggtgccactgccgtccatctgcacagggttgtgtgctgggttggacttggctttgtcccatggtcggctctgtaagccgactccagttctgaagtcaccaggagtggagacaatgacagggatgatagtagcaacagggtttttaatagcacccacagtgcagttaatgatagcttatttaacctccaaaccctctgagtactatcatcatcccctctttatgcatgagacacaggcacagagaggtttagtacctcccccgaagtcacgcagctcgtaagcctgggtccttcccgcctcatccttttaggttatcctgtgtggggcatcctaggtacgttccctgcattgagcggcagtgggagcaattcctgtcttgattccacagtgaagttattctgagctgtggatgaccttgcatcccactaaggacaaagctaggtagcttcgggtctcctccctctgataggcatcatcgtgcccattctacagtgacaggaggccaggggcaggggagtaagtccagagtgggcccccacactgctggcgagggccaacaactccctggtgtaagagcaaagctggaggtggggtggagctggagcccgtgatggtgacaggacagggtggggaatgacatgaccgtgccccgggtcggttggaggtgactcagccatgtggcgttggggtgcctttcacacgggggaacagaatctgggtctgtcatgggctttaccctgacttcaggaattcacttgcatttgagcatgtgaaaggccagagcgtgggacaggtcggcactgtgaatgccctgaaggactattggactcccaagtgtcagagaggctgatgaggcccaaaaggtgtggatgaggcatgaaccctaggttagggccacctagggctcctgaggtcaggggccggtgcacggaggtcacactaggcaccagagggaagtaactgatgggtgctcagagtggaaagtcccgaagaggacatgttgaggcacagctgaaccagctgggtccaggagtacagacaccgccttgggggagctgccactggcatagctctctttccttctgtggtgctcgcccttaccaacagctcactcctgccaccccaggggaaggagaggcacccagggcccaggagggtgtgacttccttacctgtcttctccccagtgaattctttaacacctttcttcccctgcagggagaggtggctaagggtggtagtcgaggtgtgtttagggtgtcccagactcaggaagccaggcagtgagcttaggcccggggttggggttgagcacactgccagacgctccgagcaaaggtagctggacagcagcatttacgtgatgtgtctgaagtcagaaaactgcagccatgtgggccagagccttcttgttggggtaagctgtctcctcttcttcctcttcctcctcctcctccttttttaaaaaaaaaatatgacctgtgacttttatctcagagtatctttttttctccccttgtgatctgggcaaatgtctcatggaatgttccagaaagttccaagtctggagaagacacgtctggcacctctgcagatgctgtttgagaaagtcagggcccagggttacatacagtctctgcttctgaatgatcgtgcaggtgcatcagggcctggggaaacaccaaaggacagcgactccagtggctagtgactccactttgccattttgctccaggggcaggtctgtcttctgctgacggcctcagtttttccatctgtgacatgggggatagctgtgccttttgggatattgtgaggtatcatggtgcttgtatagacttcagtctggtgcttggcattttgggggtgtgatgtccttgtctggttgagtccttgtgggaatgttgggtgcctcatctatctgtcaccgctggctgggtgtggattttcaggacctggggcagtggctactgccttccatagctttggctgtggcctagttggctggtagctctgttgtagaggatggcccctttgggcatagggtggtgtaccatagtcttggtgtcctactgtgctatgggcactggaccaagtattattctagtgcagtgtgggaagtctcctgtgccagcagcagggaacagagatgaggggaacctcccctactggggtagaactgggtacctcatgcctccctggaagggatttggctctgtggtctttcttgctggatctggcaggcagtgggcagtaatatgggcccggtgacttttgtttggcttggtagtggtgttcctgttggtttccttgggcccagggggaggggtgggggaggggagggagcgagggctgtagctcagttgagccatgagatgtgatctttgggtagactgtcttggaccatcccaaattgtgatggacacaatatagtgttgaatgccctgaggttccaaggagacactctgtgggctggagcatgggtggccaatggcttccacagctgagggacatcaggtacaaggactaaagaaagggtctgagtgcccttgacacacctggggagggattgtggccctacatagcctgatttcagacctcctttagctcctatctcaaccccccccccccccccttgagtagctggtcggtcattgtggccacagggttttattttaacttcacatatgttggaagactctgactgctgctgtgtgcacagtgctccatgtacacgtttcttgaatgtccagcagctctagtcctgggggccaggagtctggggcatggggtgccttgctgaggcccaaccctcagttgctttggtgtgtggttgtcttagtcagggtttctattcctgcacaaacatcatgaccaagaagcaagttggggaggaaagggtttattcagcttacactttctacattgctgttaatcaccaaaggaagtcaggcctggaactcaagaggtcaaaaagcaggagctgatgcagaagccatggagggatgttctttactggcttgcttcccctggcttgatcagcctgctcttccccccccccccccccccccccgccccacacacacacggggtttctctgtatagccctggctgtcctggaactcactttgtagaccaggctggcctccaactcagaaatccacctgcctctgcctcccgagtgctgggattaaaggcatgcaccaccatgtccggcttagcctgctctcttatagaaccaagactaccaacccagagatggcaccacccaaaaggggccctgagaaaaagccttgcagctggatctcatggaggcacttccccaactgaagctcctttctctgtgataactccagcctgtgtcaagttgacacaaaaccagccagtacagtggtactccacacctctgatacttggttattattcaggtagagattggagctagggttaaccctaaccctagatttactattgttgttttaagactgagttttactgtgtgtctcagattggcctgaactcaaagcggtcctcctgccttagccttcccaagtgctaagattgtgtttgctaacatgtcaggtgagagtaacctttaacttttgtttcccctttgagatagagtctggttctgtttctcaggctgctaccaagcacaactcactgtatcctaggctggcctcaagcttgtggcccccgctttagctagggttacagcgtgcaccaccccacctaatgagagggaacattttcagtgggtgaccagtatgtcagttctgagcaccgagaattgtttgtttgtttcttttttaagttgttgtttttttaaagatttatttacctattttatgtattatttacctattttatgtatatgagtacactgtagctgacttcagacacaccagaggagggcatcagttcccattacagatggttgtgagccaccttgtggttgctgggaattgaactcaggacctctggaagagcagtcagtgcggagccatctcttcagccccgagaattgtgtcttgatcatctctgtcttgtcaactccgaactgcttgtcaccctgttctctctggggctcattgccattgtgtccagtcccaggccccatggctgccctgtccctgtgtagactctcagataagaccttgctgtgtagtgtgtcttgtttctcgtgcggctttagggtgctcttctctgaggtccccgcttgtattgtcctacatttcttttcttttctttttctttttttttgtttttaagacagggtttctctgtatagccctggctgtcccggaactcactttgtagaccaggctcagaaatccacctgcctctgcctcctgagtgctggaatcaaaggcgtgcgccaccatgcccggctcgtcctttgtttctttcactgcgtggttatacttcactttgtggtgatgtagccttagaatgtcttagagtgtctttgcagttagggaaacggaggctagcatggccactgtgcatggggtccaggctcggggaagggaggtggaagaaggagcgtgggcagttccttgctctctcctgtgtttagctcccttccctgctgcctggccaggagccttgcttggggagtatgtatgttaggttggccgtagtttctgaggctccagatctcctctctgttgctcttggctggctgtgtcaccagccacaggcagtttgcctgcatccagtctcctctttggttcctattgacttgactctcagcctgtaacctcgacttgaccaccatcaccatcgtttcccgccacgtggagctgcatggagtagccagcttgcttgggaatggtgtctgtctgtgtgtgtgtgttgctggcccaggatgatggtgctatgtgaaatgctctgtgtgtagttgcttctggcttttggtgatatctgatcattaagtcacttactgaacactaagttgcctggtatctcatgagaagacagagctgtgggcatgactgcaaaaagggatatgaccgggtgatcagcctgcccctcactgtgatccgacccagtgcgctttgaaactgtacttgtgggttaacctttgggaaaggcatggttctcctgcagcctcagctggaacaaatgcagggcagaaaatgggggaacacccctgaccacagcttcctggtggcattgggatggtgtggatatggctttattctgggtttccgtctcccggtgtcacagtgagagccagggatagggggactatcccagtggttacatcttggctgaaaagatgggctttaattgccccgttgtttaatgcctcagtttcccctacttgtaaaagatggctgcagggtgggcgccccaactttgccagtggggttggggcgaccgaagcctctggaagcccttcttgggttatggacatcacagagcagtcaggagggatgtccaggtcttttggactgcaagagcttagctgtctccttggtggtctccctgtggctgttggtctttccataaccctcagtggccacaggcttttgctctgtgttaatctgccttagtcttgagctgacaggtggcggcggcagtgacttcgttttttgtcatcgtcgtcgtcgttgttgtagtatgcaagttattgattttacaatattctttttttaaatctttttctttattttcatttcacgtgcattggtattttgcctccatgcgtgtctttatgcctgtgtgagggtgtcagatactctggaactggacttacagttgtgagccgccgtgtgagtgctgggagttgaacccaggtcccgtgcaagcacagccagttttctcaactgctgagatgattctctatccttgactggtggcttcttgctggttgtggcactgtgggtaccgccacgaccctggttcaaatcccagggcagtttttttctaggactgcttcctttgggtcacataacttcctcctgggctcacagtggaaagtggggtgtcactttctgtcgtgctctagggatggctttaccccgggcaccctgcttggcatggtcgtggttgagctgtcagacataacattgctggtcatcttcagcctgatgacgggattgtggctgtgattgaagcccctgttggaggcctgtctccttttcctctcctcctcttggcccctccctggcctcatctttccatcttccagaccttccttatttccattctggccccacatttggctgtgtgtatggcctgggcttcctgcttagggggcggggtgcaaagcttgcatcatgttgacctgacttctgggtactgaagtggaagccatttgagaccctaacagagtggttctcaacatgtgggtacaaacctttccacaggggtcgcccaagaccgtgggaaaacacagatatttatgttatgatgtgtaacagcagcaaaattacagttatgaagtagcaacaaaaataattttatggttgggggttcaccataacatgagggactgtattaagagactgcagcatcagggagaccactgccccaacacctcagggctgtggcccaaagccccacagctgcagagccagcctgctttgagaaagatgcacagcccacacccagaggaggttgggctggatgtgagtcacccagcaagtcacagccagtgctgacgcctgcccaagcatctggccatctcttctggcctctgtgtgcgttcagctctgcctttttgtgggcctgtcaccaagatgacctgagccctgagccccaggcccggtttcctttagttaggatcggaaggtcgggacggacgggagcattttcctctggccatctggccctgcaggactggaggacgccagggctggctggctgggaggaaatggttaaaggaggggccgtggctggcccaggtccctctgccagcagcaaggagggagagggcttctcaaaagctataaaaaggcctcgcagtgttgagccccagtggctggaagcccgccagggttaccatggcgatgaggaattagtcccgactgccaaggctgctagcagctcggtacttttggctctggaacaagagtggacttatgtaattccgtgtttataggcctgggtggcggacgcagagctgggcctgagtcttggtggtggcccacagtgggtcacaccaccccgcagggtatccctgacacgcctctggtgccctgattttgggggacattaggacagaagcctgcggcctagcaggctgctggtccccaccagggcctccccagtcggggtgggagcccaagtctcgcgggaaggggtgcggctgctgtgtggggccgccccttgcccgcttggtctggagggaggatggccctgtcgctggccaagggctggcccctagacgcctgtgggtcgggcctcggatacagggcatgctgaccagggctggctcactgccggccctcgcttgccgcgtggggcagttcctgcaagttgtgtggagcccactcaggctgttgctggccatgcactggtaagagaagttgcctggctgggggtgcccacatccccagaccctagggatggtgccacagaccagagggctatgatttgcaggatgtgggcaaaggacactgcctgaggacccctggaattgccccagccccgtctgaggtatggtggccctggttcctgccggcccccgtcagccagctggggtggctggagaggcccgagacaggatgtgtctcagggtcctgtgcatgggacagtaggttatcttatcgggaaaagttgttgatatccggaagacgtgaggcactgggtgctggctggtggccctgggaggggatgtatggtacagacattgtgcttgccttgagcatgcctacccagtgcttggtgggatagtaggacagtgtaggtcgggccgtggggtgacgggatcagagcgtggggacttgggagcttgggctgggggggagccaggtgcaggcattgtgggcccagcctgcctcccccgctgaagtggagcttggctcagcgccctgtctggtttgaaatgagggccaccggcccaggcttgcccagggccttggcagcgcgcgaggggtaaacattggaaagttggaaaggcttcggaagctcacagcagccgcctgcggcagcaagcccagggcagaggatgggcttctccaggcctgggggtggggggttgcagctgggatgtagcttccaaggatccccaagctcaggctattgtgggggctccagaaggcacagctcatttgcctcagaccctagttgtacatccagtcccgtttccaattctgtagctttcagtgtgccccttaactcttactcttatttccctaagtgtagaaaggagtgacggatccccatgggagtagaggtaataggaggaggaatagcggaagagtaggctctggggcaggactcaagttaaatgactctggcaagccacttcctgttttggagtctcagtcttcccatctggcaagtgggcatgtagcaagtcatgttgtctaaaggacccgatgacacagttctctggcacagggtgggtttgtggtactgactagggttgtggtttctggtgaggatgacagtgacaacagcaggcttacctgggccaatggtgggtacgtgccatcttgaagaaacagtgttcatggagttgggggggggggtcagatggaagttcaaggcatagcccgagcctcgtaggacataccaccttagtcaagccctggaactccccagcatccaggtgtgccttgagggagcaatgggagccccaggggctacagtgctgggtggtgttcaggggtagactccatatgtaatcttcccggacccccttgctttgcagggactcgaatcctgggctggtgcaggccttcacctggcctcccttgcaagcccattgtcccatttcccccgagcgtgcatgggtccttgatactgcccagcgtggcttgggggttgggccaggctgggaggtcctgtgttctgctgaaggtggcgatgcttctgtgtttgtaagtgacacaccaagtgctgcttctgctggcgcagagcccctcgtgtctggccagcagcagccatctgacagctcctttttctcgtctaggccaccatgctagctgcccaccgccagtcgtcctgggagttggggcctgtacatgcccctactgttcttgtgtctgcttggagggtgttggctgggtagaggctgcctctgtcccatggggagtttgggtgatgtccctgctactgagaagcctgcatggaagccagagcaaggttgggtgtgggatggagaagctgtggcagctgaggtcattgaacctacatgtgcgcatgtccatgcttggatgcatgcacatgtatatgcatacacgctcatgttcacagcaagtatttgacggtgtgactacggctggtggggtcagtgtcctttctctggctctgatcttgagaaacagagctcttgatgattcaagtgcatggcactgggaacacctctgaagggcacacagggtcgtgggactcgcagtggcatccccaagggcagcttcacaagtttccatgtaccttgaaataagtgcggaggaaggaccgtggttcccaaggcggctgttctgagtttgtgacttgaggtgccttgtaggctgggtgatttgactcagctcctagagctccatatcttcatctgtaggatggggtgaggggtcagcaccttgtggagcgtgtgtgcagtagtcacctgcactgagcgcttattaaaagggttttatcatacttagtggggcatggtggtatgttcctttagtcccactaccgggaaggcagaggcaggcggatctctgagttcaggactagcctgttctgcagagcgagttccaggacagccagggctacacagagaaaccctgtctggaaaaagaacaaaaaagtttatcatgtcattgtaggggcattggttatctccttcctcccaccatggctgtcttaggggtagaatttgggtgtcaggcttggtcgtagaggtccttacccactctgccattttgccagccataggctggatgtttttacactgtgccctgtcatcagatagtgcggtgggctgctgtggtcaccacctgctcatcagtgtgattgcttgcgatggcctctctctgaggtcagcgtgatcgtgtggttggcctgccacccagtgcgattgtcatggtttatctgttccatcagtggcatgcacattcagacgtggccggatcactgtggcctcttctgccgttggctgagtcttcatggctggtgggctttattgttggtgggatcatcatactttgcctgctctcttgttggcgtggtctccatggtttgccagtttcacaactggcatgacctttgaggtccactagctatgtcgttggcgtggtctccatggtctgtctattcctgtcgttggcctgtggtctccgcggttcatctgctctgttgttggcctgaggtgtgaacagtgtctctcaggagctgctggttgtaggtggaaactcctctaaggcttgggcagagtcggcgtggggccaccgggcacgctattgagcttgctactctcaatacctggatggttctgtcttaggaagggtttctagtaagccaccacaaccagtttggctcacagatccccaaatcaaaatccatgggggaaggaggcaggaacccggaggcaggaacttagttaagcaggggtcatgaaggaacgccgcttcctggcttgctctagatggcttgctcactcagtctgctttcacagacaactcagggtgaaccgcctagtgttggcaccgcccacagtgggcgtggccctctcaaatcaatcaaggatcaagaaacttagcctcagacttgtctctaagccagttcgattgggggcattttcttagttgaggttccctcttcccaggtgacactaggttatgtcaagttgacaaaatgaaccccagaattgcgtaggttacatgcatgccgcagggttggatggggattcagggctacactctgagggacttctgtaatgtgaccaagcgctgggtgagaagggtgttagggaaggaaggaagtgtttgtctcatcttgcagtttttaatgggttcagtccatgatggtgggggagctgagacagctggtcactgcatcacagttcactctcagaaagcggagggcagacaggaattggtgcctagctggaaaacctcagggctccccccatttcccccggccaggtcccatcccctaaacgttcgagcacctgggactgagtgttcagacacaggaaccacttcccactcagatcctggcagccatcctgtggagtggttcaggcttgtttctggagcagagggcgcagggtcctccttgggcacaggatggagaggcagggagggggtgtggagagtgctctagcctcatgagcttgtgagctgttgtcacttggaaacctcagactgtcaggatcgttgccatctgccttccctgagatgggagggaagggtccctcctgctccagtggcccttgagaggctgagatgtgcctctgtgcttgactggtcctgggtgtttgtccccactggggatttggtggtatctatctgtctaagtccttgagtctctctgagctctttgtacctaggctggtgcttctgagctgcatccttcccttttcggtgctgggagctgtttatccactatcgaggtgctaacaggtgagggtcatgctgggtgctggcctgggcaggactggtctgttccagctgcagcctcacttggtggagaggttcaggccactgcccagagcagcttctgttgcaaggacactggtccttcctatgacctcatcaccgcacaaaagctctgccctcctgatgccatccatcacttggcttataagtgtcagtataggagctagggggtcacagatgttctacctgtgccctgacagtttgctcagctgtgcctgcagcatctgcacacagcctcttgggtattgtcacttggtgtctagaggcagtaccccaggcttgttcctagactgagggggttggcttagagtggtgtgtgtgtgtgtgtgtgtgtgtatggatagatgtatatgtgtgtgatatatgtgtagagtatatatgtggtgtatgtatatacatgtgtttgtgtgtggtatatgtgtgcagtgtgtgtgtgtgtgtgtgtatggatagatgtgtatgtgtgtgatatatgtgtagagtatatatgtggtgtatttatatacatgtgtttgtgtgtggtatatgtgtgcagtgtgtgtgtgtgtatggatagatgtgtatgtgtgtgatatatgtgtagagtatatatgtggtgtatgtatatacatatgtttgtgtgtggtatatgtgtgcagtgtgtgtgtgtgtgtatggatagatgtgtatgtgtgtgatatatatgtagagtatatatgtggtgtatgtatatacatgtgtttgtgtgtggtatatgtgtgcagtgtgtgtgtgtatatggatagatgtgtatgtatgtgatatatgtgtagagtatatatgtggtgtatgtatatacatgtgtttgtgtgtggtatatgtgtgcagtgtgtgtgtgtgtgtatgtatgtgtgtgaggtatgagtttgggtatttatgtgtagggtgtgtgtgtgtgtgtgtgatgcatgaatgaatgtatgtggtgtgtgtgtgtgtgtgtgtgtgtgtgtgtgtgtgtgtgtatgtcttgtatgtagaggcaggaccctgcttcctcagactggccagactgatgacctgtggcactcactgtgggaaaccggggcatcctttgtgtttactgggtgcccagctcctgggagaagtcatggagatggggttggaaaggaggggtctttatttaggtgtgggtgtaatggccacttttgcctggggcagaggctatgaacattcactggcctcacttgaccctagaatcatcctgttctgtaagtagctccccgaaagacacagaaagacctagaagatagtgtgaaggggatagtttttgtgtcattccgccttcagggtgctggtgcttaggggattatcccgcttcctccccggaaggccatgttcttctccttggctcagggtagccctgagcagctctgggaggcccacttcccaggcacagctttctccttggcgcagacacttcccaggctgcccgccctgttctggaagaccgggggtggcttctcctgccacttggagccagaagacccgccccctgcctccagtcctgctttgacaatgcgtcctttgtcccctggtccagcctcctcccagctcccagcagagtgcctctgcctatgatgtcatgcccctttcagtcaggtcccaggccggtggccggggtggaggcctgcagactaggaaccactgacctgttccttactatgactgggctaccctgaacccttcaaggtcagggtcaatgttctctcatgtgtgagtgagtgtgtgagtatgtgtgtgtgtgtgtgtgtgtgtgtgtgtgtgtgtgagagagagagagagagagagagagagagatcccatttacagagcaacacacaggtcccagctgggtccttggctttgcctttttctctcctctcccgagccacctccagcttcttcgcctgtgagtggatgagtcacggagctggcctctcccaagagccttgggcgtgagaccctggcttcctgccaatcagaggggcctcttgggccaggaccatgcccctaggtgtccctgcgtgtggcttcatgcttggcctctctggctacatggagactccatagggtctagccgtgggcttgagggagccttagactcagatcgggtttaatttagagcacacaggggtctgctcaagtctggctaccccagatcctgtgacagcatttagaaattaggtcttgcagggtgactgcagatagaatcaccgtgcatttcctgggtggtcaccatccttctacagtgccatgataatcaggagagagtctcaggaaggaggccagaatgggccaacatagccatagtaaggacccctggacttgctgagggtggaagaggctttcaatctgccctggaaccctgagaacagcctaccaggcctccgtagctgaggcagaatccatttctgtgttttgaaggacctaccttgtggtttttatagcaatttagggaagacttggcctggaacgcagtacctggggtaggctcacttgggctctccacctgcctgctgtgtgaccttggacactttactcagcctctctgcacctctctctgcacctgtacagtgtttcagatgggatctcaggccaggctgtcagatgactgggtaggacgccagcagagcctgatgagagtcagacacagggctggctaccaagatggcaggagctgttcacgttggtctgtcaccatggcaaccacttaggccctgagatggaaacggtattgccctgtagaaagagtctcttcctccaccgtgtcacatggagctgtggcaggcacacagatggagaataaaagcagagaggcctgtaggatgttttcttgcccaccttcaccaggggctgggtggtcctggaacttgccatgtagaccttgctggtcttgaatgcacagagatcctcctgcttctgccccctagtgctgggattaaaggtgtgtgctaccatgactggcttacttctttctatattctagaaaactgagctcccatcaaggtagaggagggttatggtgaaggcaggtgtgtggccctgttcatcagctctgggctcctcacccatagtagcaatccctttgcagagaggctaccgtgttcctgcagaatctatgtggaggcttcagtttctgccaagtatgtccgccgccaaggactgacccagatctgcaagatctgtgagaagcaggcactgtcttcgaggcccatgtccctgttagagtcaccaacagtgaggagaggagtctggcacgcctgctttggttcccgccacagtgctcatttaacaaccacctccttgctctgttttgtacagaagaagagggacctggaggctggagatctgtgccaagagaccttagaggtgtctcaggacacaactcgctcaggtctccccatggcaatgggaggactctctgttcttcttacgtttagtacagaagttccaggtgactgagcagagcttcaggcccagttggatccaggcgtttggtcttttctctttggaagttcgccccgcgcgggagagctcgctcgctgctccagacatgcccacagaatcagcgcaggtgcccagtaagatggcacctacctgtgatcccagcatttaggaagctgtgggcaggaggatcagaagttcaaggtctccttcagctacatagtgaatttgagacctgctacttgagctgggagggtgctgtgggtattagccagggagactggagtatgctcagaggaggctgggcccactgctgtctgactccacagggtgtagaaagagccggtgtagacccccaaccagcctgatgttgactagttagcgtgtctctttggaggaaatgaagtttatggacggatggctcactgggctgtgcaccttgtcaccagggcactgggcctagcatgagtgttttgcttgttgtaggtattgctgtcatgtggggtactgccagaggcttgcaaagctggctggcggaaggtacacatgggtctatcttgggcccctgagcggcaggctgggttactgggtagtgatctctttttcagagaccacactgagagatgtctccaagtggaactggctttctggctttgccttcctagctgctttgctgagatccagtccagctcctgggtctgtgctgttcatagtcttccctggtttgcatgctgtgggggcctggtggctcctcttttgtctcccgtctaggccctcttccctgtatccttggtgatctggccctgtccatcctgcatgggcgaagtttctggaactgcctctgggtcctagggtatctgggtgcttactgtccttggctcctggccacagggtctccagattcttcatggttgtctgatgtcagatctcttattgatcattgctgagttgctgggccatcactggtgactgtgtatgtgccctgaccatgctgatcctttggtggccacagatttctctgctggttatcagggaagatcaggtaggtagcgctgtagctagccccgagctggctgggacagggaacctgcattgcaggggtcctaagggtcccaagactggacagctagtgacctgcaatttttgactgcagagacacatccacatgtggcggtctgctattcgttcaggccatcagtgatctctcctagattcctccaggagcatcctgaggactgtgtgtagggagggctacacagggacacatccagtggctaggcaggcgaatgtgtggtttcgtggacaggtgggcaagtggggctctggcccagtctggcttgcagggtctcatggtttgcatgaaactagaggttctggaaagctcttcccagcctaggcccacggtgagctggtggattgcaacccggccgattatgaggcatttctagacaggcccagccttgggttttgtggggtgaggtgggttgagggggggctttacactcattatgccgggcatggagtctctggggcccatagggagttccatcaaggggcctcctggaggaggcatgagtgttcgtgcctgcgtgtgtgtgtctgcccacattgtgataattacctcagtgttttgaattgcatggcgtctaagtgttggatgttttctcagtgtgcagctgatctccggagccttctgacctgtgaaattctgccctgagacccctcccccatgcccgccaactccctcttccctattctagccggcactgtttatctctggccacctgcttgtgtgtcacctgggctccttttgagtttctcttgtgcagagggagatgaaggacctaagcctggctgcccagggtggctaggctggagggtgaggagctggggaggagtgggcagaacctgatgtggggaccagagaactgcatggccaggcgtcaccagctgtggttcagcctcccctttccccagtttaaagttaagtagtgggctgggagacacttcagtcagtaaagtgcttgccgctatacatgcatgagaccctgaattccatccctagagcccagggagaaaagccagacaggatggcccgtgtttgtaatcccagctccggggaggtagagacaggctgatcagcctagcttctcagggaattccaggtcccagagagaggtcctgtctcaaaatatagggtgcttgtatcctgaggggtaatacccaaatttgatctctgaatactatgtgtgcagcatgtgcctgcacgtatgcgcaaatgcgcatacacacacacaagcaaaaattaagcacagagaaagccatagggaagaagtgagtctgatttgccaggagctagtggctggctgcagcccaggggacacccatgtggctaagtaccagaacctgtggcccacgcttagtcagagttcttcagtgcctaggtggccaaggcctatgtctggatgctgtatgatcctgggcagagtagtgcctctctcccacgctgtggtttccccatctgttgagtggttctaggtatgtttggtgtcaggctcacagccttcagccacagcagacaccgtgaacagggcccatgatggagacccaactgctgtgctgtaggaagggggatcctgtgagggcctcatggaggctagagggcttggagcccttcccctgggatagtgcctttcgagaggtaaagactggcctgcagcttcctcgtgaagcctcctgcctgaagcacagagaagtctgtacccagcccaagggtgcacagcagggcaaggggtagagttgtccagccatttgggacagtaatttatgtgactctgttgaaaggggatctctctaggattaggtggctcttgatggcatcatgtctactcagtgaccaagaaactgtgactttcagtctccattgctttgaccatgtgcttgatcccagcctgggggggggggcgctggggaggaggagcctgtgtggtggaaaggtgatgtggggtacagggtcggaggcctttaagattgtcccccagtgtctaagtttgttcagaagcctcagaaactgtagagaagacattgccagaggacagactactcatgtgttgatacggtgttcctggcaacttccggctcccacagaaacacaggagccggggggtggggtggggtggggtgagggtggacctgtctggcagaatgtgtgaccagtgtggttcctgtccacaaggctttaggtgtctctgggaactgggctataatgtcctcctgggatcctctgcccagggaacttagtattctgggttctgaagcctgagcagggaccctgggccccatggtggatatgagctctggctgcttctgacggccacatacattctaattctgggatacccctgtcatctcccgttctcctatcagtttgatggcagtgggtgctatgttttcaggatgttgtaagctagtgctgcagacagcatgtcgaatggctgtcaccccagtttctctttattccaccttccttgtctaagctaggccactggctgtgtctcagagtgccacatgctgcctgcagtcccagaaggaggttgctgccatggggcagggacacgggtgggcccttatcactggggctgctttcctctgccggccacggtcctttgctgtgagtctgttgtgctagccagcaaaaggaaatgggcaagggataagggcaggcatgtcacctaagatgtgtgatggacaggaatggccttggaggatgtcccggccagaggccatgactgtagcaatgcacaccctgggttcagctagtccccgcccctgcagagtgacacggttccacggtttcacggttccatggttccacggaggcggtcttgttaagattgccatctgagagcttcttgccttctgggcttctcctttggcgctgcctagacaggttcctcctggcagaccgtgcagccaggaccctgctgtccccaggctgccgccactccaccatggggtgtgtgaagatgtccctccctgttgcaagtgtgtgaggctcctgtctggctcctacccgatgcgctgccatctgctctcttcccttcccagttgctgttgccccgtcccacagtctgtctctagcttggacgtttatagtggttcacccgccagctgtactgcccgtggcaaaacacggacaccatactgtctctctgtcaccttctggggctccccacggctcctgaaacagaatctctttgaattcaccgtggtctgtggggccttgagtgacctccttccgcctaattcagtggtgttctcagacatagactagtttcactcctgggcttttgccgggatgatgctctctgcctgggacactctgcttccttgttcccataacagttataaagcctgtctgttgtacctaccctttgcctttctgacctgtgctgtgccgcatgtggacatttgtgtaagttggtcacacactgtgttgttttaagtatttggctccctttactcagtgcgacatccctggagccatctagtgtgatctatgtcagtaacccctgttttttttttttttttttccccttcctgtttggctatggagcactctcattgagtgggcagggcaggctgctgggtgtttccaccttgtgaccgttgggaatggggtcgttctcaacacacaggcatgtctgcatgactcttgagttctttgggctcctgggagatcttcagatctgtattttgtgtgttgaggtcctgccaacttgttttcttagtttgtatttgttttccaagctagctccaaatgaggctgagggtaggagatgtgaaaagtgggttggatataaactcatagggatgggagtggccacctgtgggggtgtgtggtctcccatgggggtgtggtcactcattggaaaggggtcacccatgagggtggggtcactcatgggggtgaggtcatagagtctctgactttagggctaccctgcacatggggatgctggaaaggatttggtagggtgaccttggaccatgcagctcctgtgttcctaggggatgctgtgtgaatcctgggccagctgggctgggctgaggtacgaggttctccagagatggcctacagaggcatcctctctgcctcccctacatttccactggccaagaggaagacattgtgaatgattaccaccttccagccttcctgtgtatccccaaaatcaaatagtggttttgaggccatccgcaggtgttgcatggcactggaccaggtgacccaggacagtcaaccttggggtggggttgcactgagggtgctgtggactcgaggtgtggtgtagacctgtttaccccagccccacccaaggcagcagcttgtcctgatcaggcacaggacagctgccatgctggccttcacacactctgtgttcataagtgtcatgtgacatgtctcattttggtgcaaggtagtctttgtgagccagagttcttggtagcaagtaacagaaagtcagccaaggccgccagagcaaagccacgcctgcccagggtcctctgggatggctggctgctggctttgtcagcggagttacctgcttatccctttctttctgccccaggctcacttgtggttggtgatggtgtccatgcagctggtgtggagaatacttgggcttactacaaactgggggcacaccgtgctctggccccgtgagtgcacactttacctgggatgtggggatttaggaagcaggcctgtagcagagatcttcttgtctacaattagtagttggttattttgtttgtttgtttttgttttgttttgtctttttggattttttgagacaggattgtactgtgtattcctggctttgaacttggaaatctgcctgcctctgcctcccaagtgctgggattaaaggcgcgtgacaccactgcccagtgttttttgttttttttttttttaaacattttaaactgggaatttagcccaggacttcacaaatgctaggcaaatgctgtattactgagccatgcccctgcccagacctgccactgggattgtaggaagaagtactaccactgagctatatccccagcccttttcactcctttctccctcccttatttcctttctcccttcctcctcccctcctcccctccctctttgtttctttttcttttttcccaagacaggctttctctaggtagccctggctgtcctagaactcacaactcactttgtaggccaggcaggcctcgaactcagagagatcctcttacctctgcctccctagtgctggggttaaaggcgtgcgccaccatgcctggcttcttttcacttttcaagatagggtctcacttagtttctcttgctgactttggatttgcaatcctcctgtctcagcctgcttagaagatgaacaggtctgtgcacagtgcttgcctgtgtcgccttctgacccttttgctttgtgtgcccccggatctctgtgtgccagagtttggtgttgctgccacacgggaggaaacatctcaaaggtgtgacctgggagaggaatatgtgtgtgtgtgtgtgtgtgtgtgtgtgtgtgtgtgcgcgcgtgcacatgcatatacatgggaatatttaggaagttcattggtgtcatcttgttgaccctgaggggtagggacagtgccacctacatgttggaaatgagagagctaaggttctgagaaggggaccgtactccctgaagctgtggttcttggcatggttcttggtccagtgttcttgtgttcataagtgtcatgtgacatgtccttttgatgataggttctgtgtgagccagagttcttggtaacaagtaacaaaaagccagtcagggccatcagagcaaagccacacctgtgcagagtgctcaggggtggctgtccactgcattctcaggttgacttacctgctcatacctcagccagtcaccacctccccttcctgaccgtcttactggccgtgcctgggtcacatggctcttcttggggcctgggatggaatgtcaggtgcacactggtaggttaaggagggaccgagtgcatatgtcaggacctccagcttaggaagggtttggatctgcagtcttctcccctccctgcttcatttccctgcatgagatctgtcacaggccatctgtggcttgcttggaggacagttgctaccagttagcccaagaggaagggctggggttaaattacagggagctaggggtctggccagtctccttctcatcctcatgtatcattgcttaggatacagctccagcctcagctctgggtgtaatgtgaaaaggcagggcctttcaggaaagagaagaaggaccatagggctgtctcagacttcccgctggggcttccctggctcctgcagtctcttggttcccattcttgagagcactgactattgttgtaacttgtcttatattagtcatggaggttcctgcctggaaggtggcctttatcatcctggacctgtttgttgcccaggatggatttgttgtccaggatgcttgtgtctggttcaggccgtccctagtgtggccctaggcatcctgttccctgactcccagtggcagtaggccagtctcctctgtgtcctttccatatcatgaatcagtctctagctgaggacgaaagagcagccaggcagccttgctttagcaactgtgtcgctctgtgacccatagtgggtcactgccatgtaccactctgctagcacacagctcagggacaggcccagcagctgtgaactggagctgctaggggcttttgaagaactttgccctggagatctggaaagtcccagctatgggatgaactggctgaccaaggtgggtgtgggagccgtgcggatggctgtgggtacggtgtccacgccgaggctcccaagcctgctggttgaggcctgttgcgtagggagatggcttgtggaggctaggcacagtgctttggcattgggctgtccttgagcggaggctgaggcaggaggaaggactaggccgcagtggctgtggaccagctgcctcctgttcaatttgtttttttttctcttctctccacaggcacctgtgacgaggtcacctgccagcagatgaccgagaccagcccttagtcctaggtgtggtcaagagtgtcttgggctccaaagcctacctggaccctaccaccatgtcaggatccacacagcctgtggcacagacatggcgggctgctgagccccgctacccaccccatggcatctcctacccggtgcagatagcccggtcccacacggtaaggggcatgtctgctcagtaccacttccactactgcagtgcatcttctgaagccaggctgctgcggcccgtgctgatttggtctcagtggggacactggtggcagtcaggtgtggtgatggaggcctgtaatcccaggattgaggtggtgaaggcaggagggtttcaattttgagaccagcctagctggctacgtagcaagtcttattttagtatgggaaggtggaggctgaggctaggctgtgtggatacgctgcttatatcttgtggacttggcaagtacaatagagcacccacggtgtcacccccctcccctccgacccatttccaccatgtttgggactggggagcttttggggagggagactgaggttgcacttcttcctaaccctcaagatcttcgtgcctatttcaactgtaagactctgagccccagagcagtgtccacctctgccagggtcctgttcctgctcatctcgtactgctagagggagcagactgggcttttcttgttgcctgctgtgtactctttctctgggctgtggagtaatggggtgtgatgtgagatggagcagccacagctgggtgggagtgcgcatgcgtgcgtgtgtgtgagcaggagagaatgtatgtctaggcttgtgtctgtccctcctgggtggcatggtccatttctgtgtgggacgtggttctacttgtgagtcaagaatgctttctcatgagccccagagcctggccttagggtacccagcttcatactctcggtgtgtggagcagctgaggcctggagggagaagacaaaccctaaccattggcctggggcagccagtgttggggttctacattccctagctcccagcctttacaccaccacacagcaaccatgatgcactgggtgacaaccaagccagcggcaaggacatctactctccaggctggcgagtgacccagacgggccatttactgtttgggggggggggccctcagttctgtcacctataaagcagggatgacagcaacacccacaagaaggcctatgcatgtccccatgtggctatctgctgtcaccataacttggtgactgttaaagccatttcctgatgggccctgcctggggttctatcatctctttgccctcccctcctcccctcccccatcccagtccccccaggcagatgtctgtggcttcttccccttcattcattttgctcatccacccagcctctggctgttgtgtgtccttccctcattcctgaattcttgctctttgcctcatttgtgtcctctccccagtatttggggtcactggctgaccctaggcaccgcccactctcctgctgggccattggtgacgcaggatgccgctggcccagacccagtagttactgatcctgtggcctgatgggatagcttacagtttggaacatgtctgtcccctggtggggacttgcttgctctttggcctctgttcatccccagggtctgtggagggtttctctctgggagactgttgaggcctcattacttttctatgctggcttggtgaagcctggcatatggagcccttggtccttttcagccttccccataaccccgccccaaccctgccccacagcccctcctccaccctcttacccaggctcctccaatagccccgaccttcctgcagcctgccctctcagcccaccctcatttccccagacttccccaaggcccttcctagtccccccacccccactgtaccccatctctttcctgtggcccaaggataagtagaacacagactggaaaagaccacgcgctttcccccttaacacttgtgtcttaggaaagagaggcctgagaagagaagccatggatccatagcaaggtgacaccccgtagggggagagccactgtgtgtgttctagccctggtgcggaccagctcagcctgtggtgtcctgggcctggggaacatgatgggccactttttttttttttttaagatgtatttattattatatgagctgtcttcagactcgccagaagagggcgtcagaccatgtggttgctgggatttgaactccagaccttcagaagagcagtcttaacccgctgagccatctcaccagctcttcgggtctgggccacttacatactctagcaggtctgtcttcccggaagctctgccctctcagtcaagtgagccacttataaaatggctggggttctgctgaggtggcatcatgacgtgatcacttgggacgtgagccggtttctgtgtgatgtgacaatagggacggcaagtatagaggaccccccccccccctacagcatcaggctgtcaatcccctcgtttcaccaggggtaacatgctgcctatcagcaccagtcttcgctccccagaccctctggtgtgtctccctcccctgcctgcatgctgctggcagtggggtgcaagagccacgtacccgcaggtcagtgtctggcaaggtgtgtgtcagggacgcctgacaaaattggctgtgcctaaccttggccttgggcctagctggctgactcttggttgagggatggacctgtgggctgttgttcagttggtcacaaactctgctctgccacccagggctcagcctgctcctgtctaatggcactggatgctggccggggctgatgtcctaggtgtgtgggcacatcgtggggtcctgtgcccacctgctgtatactgtcttagggtcctcatctgtctgtccgtccattcattaactctctggctcggtcattgacctgtttgctcattcatccactcattagtggattcacttgtccatttgcctgacaaatacaggttagatttgtcacatgccttggagaccgagctgtgaaggcagagatgccccctctctggggaagtcgacattctcttggggtacagtggaacaaagatggggctagaggaggccatatttaagtggagagacaaatattgatggtggagctgggacccaagaggacagacagtgggtgcatggtgtctggatgcacagcgtcacagaaaaccctgacttgaggctcttttggaatgaacattccgttcaggggtgacaggggtaggctgaactccgcctccgtgtgattttgtgtggctctctacgtcttagactcgtgctggggtacagtgcatttgtttcttggggctcccctcttgttctgtttgtagtggaaatatccaggggctggggtgggcctctacccctgagtcaggtgttataatcagtacggggcaggcttgaagcctgtgtcctgtgactgtctccgttcccagcggaggggccagttgagcctcacctgtactattcttgctgtgtgaccaggaagagctgttcttgctcatcattctcttgatgttcagatcgcccatgatatcctccttctggagctgctttttttgggggggaggggttgtcacattagtcagcttgtgcagagggcttggttacggcgacctaagaatgggatcatttctcttgatgtcgtccttgcagggccatcctggtatccttgtccttctaggtcgtgttttgcaaagtcttgattgcccgctccttcccttgcagtttggtctctgaggttttccagttgcttgccgtctagggtcaggatccggctgctcccccccagcgcatatgactgctaccattggttctttgcagtgagaactgctttaagacacagagcccggggctggagagaggcctctgctcagcagttaagagcctgcgctgctctttcagaggatctgagcttggtgtcaagcactctcgtccagcaatgcacagctgcttctgactccaggggatccagtgtcctcatgttctctctggcttatgtgggcgctgcacacataagacatacacacagatacataattaaagataaaatgaaatctacaacaaaataaaaagggctaaaaaggagaggaaaatatgccaaaggaaaactaagtgacctatataggtcatgctgtccacagccatacacgagtcagacattactaatcgattgccgtgcatgtaagcaagcatccaggctgacagaacagattgattggtctggcacaaggcggaaacctgtcttgtttttcttattagagatggtgtgcacactgactctcctctcccacttccctcattttcccccagcgataaagtgatcttagtcctggtgaaaaatgtaagaaggctttatgcaggggtttgtgggatccaggttagggctgagggtgtagtgggtagtgagggcgcccggcaccgcaatgagacttcaaggttggggaatttatcacctatgttgactccctggcactcttgctgcaagggtaggctaaggttgaggtctactttatgcaccgtgacgacccaggtgtgatgagcaatcacattgttgttcaaagggggagggtgtagcttgcctctgcctctccccctccccacacttcataaaagaagctagctgtttttctcacggtgggcggggcacctgaacagcagcttggctgggacctgcgtttacatagctccatctgccctggctacgtagtgcacaccccccaaccccctttcctgtctgagcctgactcttcaccgggatacctgtccaaggatacttgggtctctattgaaggcagatacatttctgctccatgggccgctccatgctcagcagtgccctgctagggcagctcccagccctatgtctgtaggcagggcctgggagaggtgatccgttcttctctcaaaacctgcagcagggtggtgtgggcaggggtgaaggtgggataggcaagccgaccctctagcctgtagccttaggggacctgtgcttagacccactgccccttcaggtgcaccagctggagagtgaggcaatacaggaacaccacaggtcccagagaagcccgagtggaggtgtagagtccagtattgtggtttattacactcttctacacccccagcaggatcttgtagctagacagggctctaagcatggtgggaccatggtggtggcaattgtagcttgaggatatagactgggaacccatctgagcctcttggtgcagggtggcaaggaagctgtcgttgttcctgtgctcgctcactgttccctttcttctacaggacgtggggctgcttgagtaccaacaccacccccgtgactacacctcacacctgtcacccggttccatcatccagccacagaggaggcggccctcactgctgtcagagttccagcctgggagtgaacggtgaggagaagttgtgatgtcttagtctaggctgtggtgtctctgaggtagataccgaggctttttggtgggtaaagctgcaggggcccagactttagcccttcctagtgccacttatttctggtggcatcctagggccatgacagggccgtgctttcccaagagcagggacttgtcggcagaggaggcagctatgaccatctacccaaggttgaggagaatggttaagagcagaaggctcacacctctccgcctgctggctagatcaggtttaacagcaggagtgctgtgatcagctagtgatgtctgcccagggagagtgaaaaggaatagtgttgtgtatgctgttttgtgcataaacctcatggtgcttttcaagcctgtgctttaaaacacccaggggtttgttaaaatgtagagtcttggtcagtagcagtgcaatgggtcttacggtttgcatttctggttagctcaggagggtctgtgggatcttcaggctgcaatgagtggttcaggctgggtagtcacaacaaggcctcacgagacagaagcatgtcccctcctgtagggggaagacagaggaaccttctaacaaggctcctcatgagaacctggctaggtggacacctggagtcttggtcccaagcttctgtctcctatgtgatgtgcattcctggcctctcacaggtctcaggagctccacctgcgccctgagtcccgcacgttcctgcctgagctgggcaagcccgacatagaattcaccgagagcaagcgcccccgcctggagctactacccgataccctgctgcgcccatcacccctgctggccactgggcagccgagtgggtctgaagaccttaccaaggtataccccagccaggcctgtgggctctatttattgctgctgtcactgctgctatgggcaggaaagggcctgggggcggaggcagggaaaggctgggtggaaggagggagggcagctctggtgtgggtatgagggtgggactgagcactggagctgccaccaggtaaggagagagggtgtgggtgatggaaagaagtgggaaggtatctttaggtggcagggagtgtacagaccctgtggcgggacgcagtgtgtggctgttatcactggctggtgtgactgggaagtgcagagtgagggtcctgcaaaagccttggagttggggtggggctgggctgtacaggtgacagcttgtgtggaacagtggcttgcaactcctcaggcttcatgtagcagactgcacagccagggcagccccatgtttgagcaagtattcaggaaggcgaccctagagtcccttcagatgagacagaaaggatggcacagtgcctggcatgtcagggtctagagttgagggcctcaggaagattgacagacagatctgctgctgcccaggtctgagtggctccttgggtgccaggtaggctggatgggtctatgtctgtagccatgtgggcctgcctgaggagccccagagcagtgtcaggccaagccctgtttccacagaggctgtcactcgccttgtcttggcttagtcccatgtgttcacacaccctggtatactagagaatgaactcgggaccttgtctaccctaggacagtcctctgccaccaagctgtatctttagacctcttttaatatatatatatgtatgtatgtatgtacacacatattactttttccccctaaatggggtcttgctaaattgatcaggctggccttgaatgtactctgtagtctgggcaggccttgacatcaaagccttgcatatagttctgcacagctctgatgacaggctaggactccgagccaggcttgctctaagccttcagtctgttctctagctctccctttgttccagctgtgctgtcccaggctcgggcctctctgagcctagcttgctccttgttagtcagtagcagaccgaccttaagtgacccaggctatctggaaagagggtttggctgtgagccttgaatacacaccttcaggctggaccaggtgacaagaccagactctggtctccataggagagtaaagatgctggcatgagttctggaatgttcttggcgtcttagagctataggagtccagcccattcccagtgcagtctgttcacccctgtcagacaggtgacctaaggctggcgccaggatatcaggacaatacggccttgtttcctggacattgattggggtatcctcattccctgccccagactatccctgggaaataggacagttccagactgacacgtcacccagctctgtctggcagctcactctcctctgttgctccaggacccctccccctttctcttctacccacttagcccatgagccagcacccatatcctgtcctgtagacaactggcctagccactgcctatcctgggtcggcctcagttgccccaggccaccgtcactcacctggactgtggcagtgacctctcatcttccctgccactctcccttcaccgctgggtcatgtggagacaagcagggtcttcggtcctaaacctccttgctcaggcatgaaagtctagctccttttcaagtgtttggccatcaggtctggtgtgatggggcactgaagtcacctctccataccaccagtcccctgtgtatctttgtggcctcttaaacctggcctggccccacccctaggccctgaaactgctggtgtgcatctggttgccctctgttccctcagacgcttgctggactgatggcagtgggtacccaaggctggctggtgggatgtcgtgaagtcttggcagggtaccctgctgaccacactgggtctggacttggcccaggtgtggccactgggctgtcctcctgcactcctgggtgatctgttccctctgtcttctggtctctggcatcaccttcttgctcaagtgttactcctttctccccatcatcccttttgccctgtgctcgccccttctccctcctcccctctcctaccatctctctgcattgtcttcttctagctccagttatctttgtccccacccttccccccagctgcccattccagtcaccatccatcttccctgcttggttgccataaacctcctaacagctgccccatccatccatctggcctcatctgtctgtccatccatttgtgctgtccatctatcccccgccccactcctgggtcctgtgactggtgcaccaggatggtcatttcctggctggctggggacagctatctctgtgcattcagactaggtgactgccatgccttaatgctgtcaggaagctgagcgtgacatttgttcactgtctggggaactagggaccaggcttgaaatgggagtgaccactcaagacagtggggtggggttttccttcagcctgtactgcaagtggatgagtcaaatgtctgcaggctaggtgggggccagtgtggggtgggcagcaatgaggaggcataaccaggaaggccacaagggtgatgtgctaataccaagtatacacttcacagtctgtcatatgctaaggtcttcccagaactgtggaggcaacctaggacatccctgtttggagctttggttgagagttaaaagtaggggatgggattcaggtaggcaactccttcgggaggctcttccctgccctggatcccctgctatcctgagcttctctccctgcttcttagaaggcaggagaggctatgcgtggtaagccttcatccgtgggtagtagatgggtgggtgtctcaggaccagctctgttctgggttttgtatctctgtaggaacctgtcagcctctgctgtcactagctgcttgccagagtgccccagatctagcctgtggctctgctgagggttttgtcctcgaagtcaccactgaggccacgtggggctcaggtgttcctggcaccgtgtattagttagggattgccattgctgtgatgaacttggggaggaaagggttcatctggtattttggtccatatcaccgttcattaaggaaggaagtcaggacagggactcaaacagggcaggaacctggaggcaggagctgatgcagaggccatagatgaatgctgctttctggctgggtcctcccccagcatcactaattaagaaagagctagacacacaggcttgcctacagctctatcttatggaagcattttctcaattgaggttctctcttctcagatatctatagcttaagttgatggataataaagttagccagcccaactgatcccttgtcaacttgacataaacacatcactattcacccataacctttcttttcttgttcttccccaagattacacattaatcctcttaaaatatcagtcttgcgctggagagttggctcagcggttaagagcaccgtctgctcttctagaggtcctgagttcaattcccagcaaccacatggtggctcacaaccatcagtaattagacccgatgccctcttctggtgtatctgaagacagctacagtgtactcacatacataaaataaatagatctttaaaaaaagtatatcagtcttttaaaattcaaaatctctataaaactcaaatttcatttttttttaagtttaaagtttctcaactgtgggtgcatgtaaaataaaaaatgagttaaataatttatttcaagagggcatagtcacagtcagatcgaagaaaaacccaactcacagtgtgggattcactcatgatctctgggctcctctgaagaagggcttgtcttctaggctctggcaggctccactccccgctgctgctgttcttgtggttaacccacagtactggcatttccaaaacgttggggtcttctgctgctgctgggccgcactcttcaccagtagcctctcctgagctcccttcatggtaccaagtctcagcttctctgcatgagcccttcagtcctggcccttccgctgccactgaggctgcaccttcaccagtgacctctcctctcacagtgcctaaccccagcttcccgccttcatgactttaaaaccagtaccacctgggtgactcttaccttaccaagtttggcttgagagcaaggtacagcgctggctgcctctggaacataactagcgtctgtgagctgggtctcaggaaacgctcgttagaagatttcctctcagtgatgcagctctgttcttagtcaccaccgatgcctttcttacctccaggtgaccagcatcagttgtcccagtaaagcaaaggctgcacttcagtagcgctggtctcttgttaaatcatggctgactcttcagtccgggctaaacagacaccacagtcttaattcaaaatagcaaatacacaatagccccgagagacttaatgtaacactcagaattccttccagaatggcacaagccagacctccgtcattggcatttctcagtgttgttttcttccacatttccacagaataactcactgaacttttaaacactcgatgggttttcttgtccaaagttctgaaatccttccaaaatccccaccaacacccaacaacaacaacaacaacaacaacaacaacacggtcaggtctgtcacagcaccgtcgcagaattctcataccaatatctgtgatagttggggttacgtttgctgtgataaaccaccatgaccaaaataacttggagaggaaattcgggtttattttatttggcttatgtgtccaatcactgttcatcatcaaaggagtcagcacaggaacaaacagggcaggaagctggaggcaggagctgatgcaaaggccatggagggatgctgtttactggctttctcaccatggcttgctcagcttgctttcttataggacccaggaccaccagcccagggatggctccacccacaaatgctctagaccctcccccatcgatccccagttaagaaaatgctccacaggcttgctgacattctgatcttttggagaggcatttcctacgtccaggctcttccctcagatggctataacttgtatcaagttgacataaacctaggcagcacacacacacacacacacacacacacacacacgtttagggtctctgccttgtttctctgtctctcattctgtttccgctggattgtatggctctgtttctgactgtctgtccctcactgtctcagcctctcgccttcccaccatctgtccctctctcccctgcctgggccccgtctgggctggagccaggctccagggggactgggtgggtgaggagggaatgcatacagctctgagcaactgagcaactgtgggttgtgaggagtccagctggaggcaggagcaggggttttgggggaaagtttctgcccccccccaacatttggcagtaccctcctgctcgggctgcccagtgccttggctgttcatttgttttgggggacttctcttgaaaggtccttgggcagttggggcctgggacagcagcttaagcacagaccctgaactcaggtgcctataatgaaatccaggtttggtggcttctggctgagctcagcccttgtgtctgacatcaccatggcccatgctgcttcttggagtgcttgaaagacagcatgtgtgactctgggaaccccacagaggtgactctacccctcacaggtccccaatccttggctctgctggtccagccacttctgccattcctctagctctggcctggaagctgccgctgtggctgttggccacaggcctctacaggaactggaagagctcagccttggttctcattcccaggccttttgtgacaggtctttatgtcagaaatggagcatttcttactgctgccttggagctttctgcctaggcacaggactgcagaaagtgactgactcagtggagtctgactagttagctggagtgagtctagctgactgactgactgactgactgactgactgactgactgactgactgggagagaacctgttttactgactgagactgaggagagcctgactgattgactgactgggggagaacctgactgactgattgactgactgacagatggacagacgagtatatgactggctaagggagtctaaggagagaactaaattgctgcctggtttctggttgggcttagggtttctctgtcctcaggcttgggacctacagaaggagggggtcatctgcaagcaaagtcacctgccacttagaggctagcctgtcaggtgtctccggtgtgttttggcatgccagatgccatctctcctgccattggctcgctgtctatgaagccagtagcaggacagtcaggagtcaaggtttcatccctctggaaagtgttcctccatctgtgagggagccgtttgtctggcttctcccagccctgcagtctgttgtgggtggattccccctgtctggatgtttctgtgattgtgtttcactgcctttgttcttgtgtcttactatgtgggagcatgtgcatcagaaaggggacctgctgtatgtttgtacactgtgggggttctggctcgggtcatatgcgtgatcttgaggatgaagcaccatgaaagacagcttgatctagctggtccaggaagtgaggctcagccacatggagtggctggtgttgccagctgcattttccgtgctgtcccagacttggagatggagccttctgtaggtggcatggttttggagcccatcctggactgtaagaagtctggtccatggtttcaggttgcacggtcccactgctgacacccttattccaaatctgtttctccctcttctgcttttggggagcagagcagaagggacaatatgatctccgggctcagggttttgtcctcagtgccaccttctgtttggagatggatactgagagtttcctgggggattctgttgggaggagagcctggagtccccagtgtggcacctatggtttagatgatagcatgaagccggggcaaagtactgggctgagagtggacagggagagcgaaggggacaagtggaagttgtgggctcttctagtggcaagagtgatgggggtgggggtaggtgggggcacctggctgcccaggctgcagttgttcctaggaataaagcatcctgtgtccttagagtgcagctgtgtgggggcggggagcagccgcagactctgcctggccatggctgccagcagctgctgtcttggcccagagggaacagggtggggctgacctagccgggaaccagggtagggacagaccttccttgacagtgctattcagtgataactgtgtgtcagacgttttggatgcacctaggctcacaagccactgtggaggtgaaactactcctgtctccccctacctccccacccccccactgtaaagatagggatactgaggcaggcagcacctccaagcaccatctgtggtcacagaactgggtgttgcagaggggggctgggattggagcccagggctatctagatgagaactgggttgttttcctaacctctttgttgccagagcatcccagtgcagcctgggtggtccctgactagagaacaagagagaaccatgaagcagccaggtgccgggccatgtgggagatgtacaggcagcctcagggcagagcagcctgctgaagctgacaaatgcccatccatgagaaagagccctgtgtagtggtgcagaactgtcatcccggtatgtgggaggacccgaagctcaaggagaccctgggcaacatagggagagatggcttgccaccaggatcacttatagaagacataggtctgggtcccagcgaccacatgccttgcaactgtggtaaccccagttccagggcttcttgaccccgctcttttgacctctaaagggactaggtatgcatttggtgcagatacatatgtataggcaaaacactcataaatctttaaaaggttgaaggtaacaaatggcttgggcaatagatctgtggtggagcgctcgcttagagacgggttccatctctttgctctgcaaaaacagaagaaagcgaggcccagtgaccccgatggctcctgtgtgttgtgacaggtgtgttttttgaaaagctgactgctccagttcagggtctgcagcctgcttgcatcacgcacatgtggaaggcatatgtggctgagctgtcaggctggggtcactgtgggagtcttatttctgttcccgggaaatagaggtgtagccaggaggaggcagtaaggactgtcattactgcctgccggcctcctggattttgtcttcagagaacacagccatgggaagagtggctgggacgaggcaggatccacgcgtggcactgccgtcctggggatgcttagggtaggaagctggtgtgctgcggcctgaagtcacggcaaacttgggtgtcctcaacgttctctgtccaaccacaggaccgtagcctggcaggcaagctggagcctgtgtcacctcccagtcccccgcacgctgaccctgagctagagctggcgccatctcgactgtccaaggaggagctgatccagaacatggaccgcgtggaccgtgagatcaccatggtagagcagcagatctccaagctgaagaagaagcaggtgagtagtgagggcgggcagaagaccggccccacgtcctcaggtgcctggagccacacaatttcctggtggttggtgtgtgtgtgtgtgtgtgtgtgtgtgtgtgtgtgtttaatgttttgcttctggaagcctctgggccgggcccatcaggctcatatatctgcacggtcaacagagagtcctgagcttcaggggaccaaggcttcccgggagaggcaccatgagctgcccaaggcagagaaagagcctttggttgttcttgcataaaagctgaatggggagccgggagctgggcactgagggcttccaagatggtggcccagaatcccagagtgaggctgggccctggtgcggtcagattggccgtgccagaccagtggagctctcacatctccagtcctccaggcctggcttgggggctgggctggagccactgttacatgcatggatgttgatcaagtctggaggccaagtgacttgagctgctgttattagttttctttttctccttttatttttttcctcttaacctaaatttctttcttgaatgttatcttaaaaaataatttatatatatatatatatatatatatatatatatatatatatatatacacacacacacacacacatacatatatataaaagtataaaaataagattatataataatataaaaataaatgaatgagagagatggttcggtggttaaggacatgtattgttcttacagactacccaggttcagttcccatcacccacatctgacagcttacaactccttgtaactccacctccaggggacagccctaacctcatgtacatgcacatatgcagatgtacacacatgtatgtgatgtaaatatgttgtaataataaaaatatttttaagaaaataaaatatacttgtttgcctgtgcgcatgtggatactccctttgtaggagttggttctctccagctttgtgctttgtcagcctgtggtgggttaacgccaccaccatttttttttttttttaaaaagacagggtttctcttgtttagccctggttgtcctagaactcactctttagaccaggctggctttgaactcagaaatctctgcctgcctttgcctcccaagtgctggtactaaaggtgtgtgccatcactacctggctcagcacccccttttttgggagggggagtgggggaagacagggtctttcaggccttggctggcctgaacctcactagcaggctggccttgaactcacagagatcctcttgcttctgacctgtgagtgctggggttaaaggcatgtaccaccaccatgcctgcccggcccctttaagtacatttagaaagtttgatatgtgtgtcttgggtgtgtacgtgtgtgttcaggtgccttagaggcctgaagaggatttcagacatcctggaggtggagttacaggtggttgtgagttgtccagcgtgggcgctgagaaccgaacccagggcctttgcaagagcagtccgtacacactcataaccactgacctgtgtctctccacacgctcctcattcctacaaaactagaattcccaagtgtaaatgaatcattttaaagtctgcagttcactggcagtagaccgaatcatacggcttccacttcctccgcctgtcccgacagacgcagagctatttagcgatgccccatctcctagcccagagtcacccctgtgacagtctgtggagctgctttctggacacctcacgtacatggactcacatccatttgcctttcgtgtctctgccttgtgtgctcagcataaggaacttttagggttcacagggcatagtcgaatctcttcatggagaagtggtattcgaccatgtggctgtggtatgctttcttgtgtgcttgagtgactgtccctggttctcccgcccctcaccctctctgctcatgagggctgctgctcttccaggttctcaccagtgctgtttccagactgtagtggcttggggctcatcgctgactgtgtagcgtgcggttgagggttgtgtgaagccgggctccttacagctctgtgctcaccaggactgttgtgcagtgtggttttggatcttccagtcaccgttatgggagtgtgggtgactgccaggtcacactgaggaagatgctgagggtcagagaggcgcagtgactctagaaccctgggcgatggaatgaaagtctgacttcaggctgagaggtgtgctgtctggtcagggctgtagccaagacattggtcttcaccctttcaccttctctactccttagacttcctggttttttgtctttatttatttattttttgggctgatctgtgagagctgccaccaggggtcactgcaggaccaaggcagcttggctcttctggcctcagtgctgattgttcctgcctcatcatctccttgtttcccgggccataaaactctgttcctgtgtgaccgaacatgctcgctgaatgcacatagtaagcagagtggaccgtgcgctgatcgcactcatggcgccctctgtaggtcacattaggcattggcttcccgtggagtcttgaattctttgctcttggctcctgactttggagtagagcggacagcagcagcaggaagggatgccagataggagatggatgaggggtccagtgtgaagacacaggcatgtgctgctgttgatgatgatgatgctagtgatgttggtgatggtgaaagttgagatggtaaaatggatgtgatggatggtgatggtgatagtgatgggtacgagggtggtggtggtactgctgctgctgctggtgtttgttaggatggtgatagatgcaatggtaatggaggtagtggtggtagtggtcattggtgatgagcgggggtgggggtgttttaatgatgatgctaatattaatggtggtaatgatgttgatggtcagtgatggtggtggtaggatggtgatggtggtgttcatgatggtggtgttcatgatagtaatgaaggtgatagcggcagcgatgggtggtggcgatgatggtggtgatgatctgatggtagcgattgggtgctgctgctgattgcggtaatggtgatggtggtaatggttgtggctgtggtaatggtggcaatgatggtgttgatcatggtgatggtgaagatgattgtgattctgatgctggtggaaagctttgtctgtcaccagtctttcttcctttctgcctctcccagccctctccatgtagctcctggtttagtccttagaagattagggactctttgtttccagggaaaggagtaggaagttcagagacactgagtaacttctcaacaggctgtgtgggtgtacggggcagaagtgtagtgctcctggttgaggccttcactctgtgcctgtggcctctcttggagcctggaggctcagccaccagggatccctgccaagcagggcaccgagtctctgggtgactcataggaaatggcgatcagcctgacttcctgtgtgtggctacgggcaagtggggggaacagtgcctcagcttccggccttcaccgctcatgttctcccctttcccgcagcaacagttggaggaggaggccgccaagccgcccgaacccgagaagcctgtgtcgccaccacccatagaatcaaagcaccgaagcctggtccagatcatctacgatgagaaccgggtacggcccacaggagcaagtcattgaaccatgagttccctatcaccgtggaggctggcgagcgggtggggagggtggaccatgggccatgcatagcgttggcattggcctcaggctggaggagagcgagggggcctgccggccactgagatgcactgtcacctcatatctgcctagcggatccagtgacacgcttggtgatatcactattaatactggcaggtggctgcctggctggtcctaggaaggtgtgcatcgtaggcgtttccatctcacacctggagagacagacccagagatggggagtgctcagagtcacgcagccacggtgcaggaactgtgggatttgaactgggctcgtgagctgcaggcagggcctgatttttggagctttgggcttttgagcttttgactgcctggattctctgcgagtgagaaaccaaagcccagagaggaatgtgggccagacaagtcttgtgcctcaggttccatagcttaggatgtaagtaggtgttctttattgcttagggaagatactggggctcagagagggcaggagacctgcgtgagattgcacagcaggttagatttggggctgggactcagaagcaagattgaacttgcttgacggtggcggagatggtcagaggagtgtggctctctagccacattggacatttgttcccaaggctgcctttatcttgctctttgttctgctgtccctctttaagggaggtccctctgctctttctctctactctgatgtccccctgtccccggccttgtgctagctaaggcctgtatcacagccttaggaggagggcctggagatgtgtcacacacccatgcttgttcctctgccttcacggagcctggagcaggctccccagctttccccgaggaacaacagcagagcctagcattccctgcgatcaataggattacattttaatcccccttccttcctaggaagaggcaggacaggctcttgcctccagtgttcctgtggtcaggcagcccaaggcctcgtgcatctggaacacatctgtcctcaagaccaacgagtggcttttccacctcccggggcttctgtgggcatcacagttgcaggcgggtgcagcagctggaggaggggcatgccacagtcagggaggaaagtggggactagcatgggcaagagggggactgggtggtgggaggggccacagctttgatcttcagagcatgctctgcctgtcacaccttgtcacagacatggctgtgtgtgtatgtgtgacaagtagaggggtggagtggacccataggtcaccacacatttataggccgtacacttaggtctgcttagcacgtgtagctctgtgtgcactctgagagtgttgatctagatgctgggtcttgcctgtgacattgggacattgtgcagtatgtggtagtggctgaaacttgctggccccactggccccagggtctctggctgtgtggctgtggatcctgcaaaatgccagggacctcctgacttcttccttgttctctgggcacgatacttgggggcctcagacagtggtgtccctcttgttctgcctatctcatttccagggccggaccttcagatacctgtgtgctcatagtcagggctggtctctagagctggtctgctcgccttggttgtgtgtccctgtgacctgacctttgttcacagattgaagctgccctgttagacctccaggctgccctgctcacccttgggcaaggctggcttagctctaatgagtatgtaccaacatctccagtaagctggccttgtcttcacataaggatgacagataatagtgtttgggaacctgttgtatgtgacagccaagtctgctgtctgccagtgtgttgggggaagcgacagagccaggctgagaggtgacctggggtcaggctgtagatccattaagagccctgtggtcctgtcctggagcgggtgtgagggactcagttaggcttgggtgacactgctgccttgtccccagtgtcctcatcacataggtgagctacatccctggggtcaccttcccgtggctcccagacacagtggtcagttgagggtggtctggaggctttggggaagctgagccctctctggggaggaaggtgggtggagcctggcaggtaactgggacagtggcagggcagaagtgccaggatgtggctggacctatggcatctgggagcagcagggtccgcatagcaaggccccagccatcttaactggggggtgggcagcttcagcttccagggtgacagaagacagcgagggaggaggtgtgtgggagttggggcggggagtggtatgagagcaagaaggtctgcagcagccaccgaggaagccacgtttcttgatgtgtccccagttcccaaggagcgacagcagactccagcacatccttacacaagctgtgggtcttgccactagtgggtgtggcttacagggcacagggtcctagtaacccctccccctccccccagatccaaatctctgctccagctgtgtaagcacagcccctggtggccccgctgtgttaagtgccaccccctttgcctaagcacaaagctggtgctgattcccacagagctgtcacacacacacaccaagatactgtcgctgagtcgatgtgactggctcagtggcacctcccccacccccaccaagcttgtgccctgaccacaccctgaggccgctggtctcagggtctcagctctgcacagaagatctcagagtggaccttagcacacggcagaagctgctctgcttgctagcttgagcccttcccatgtctggtctgggtgggttgagattgtctgcccccaggaagctctgcagtgccatagctctcaggtgatgacggtgacttcagtggacccctgagttttcttcagcatctgctgtctgatataaggattcaggctttgccaaggttctgcctctgtgcgcctccccatcctaatccatgttccccgcttcactccctgcttcctgtaagtcggccctggtggtcccagtctgggcagccagccagcagaggcacaatgttgtcttcatgtgttggtctgagaggagagatccagcctattgaggggtgccccccacagccgtggggccctctgcagcacgcctctgttttccttaatgaggcctggtgtgtgaagggaggggatagaggccagaaatagtcactttattgtcagatgggatcctcgaaggctctggtgtccccttccgctgctctggctctgaggtcagcagacaccagaggcgtccgtgcctggcagaagctatagcctggttagccatggtcagatccctcccttgggccaacctgggagcgactgggggctcctgcagggttgtctggggtcctccctgcaggttgggctttaccctcatcccgagatgctgattccagcctgctctgagcccttgtttaattccattctcctctttgccccacagaagaaagccgaagccgcacaccggatcctagaaggcctggggccccaggtggagctggtgagctgggtgtggctgtgcgggttggaggagtggggtggaggagcagggtcgggcagcaggtgttgggggagtgggagggagggaggaggaagtcatctactgcccagcactgtccccaagggaaggcaggaagcagtacctcctgataagggcgctggcagataactcttgagtggcagctgggcagtgagcctgtccctgcctctgcagcccaaaggccactcgccatgttggctctgcatgagagtcctgcccactccgttctctgagcttgatggcccagaaaccctcaggaggactcttgatgtcttcagccctgctgcctgccatggtgggaagggtggccatgactgtaatgattgttatcatcatcgccctgctcgtctccagtgtgtcatagcagggtgggaaagcagccccggcctcgggatctgctggagtggatggggcagaagtgcacctcaccccctcaaacctgcacttgatggtgtagtcttggatcatatcagccacaggtggcaggtatagctggccgttggtgcacagggtcgggggtgtgtgtaagcacccttggggtgtggacaagagtcctgggcactgcatgcttgctgaagactgtagggccaggtctgtggtatctgtggtatacgctgacacagtcttgtccctagagaacctagggtggacagatgggtgctgggctcctctgctgcctgtggtaggctctacgtggccccttcctacacctgggagctgggcagggccgctgtgccaccaccaggtctctcactctctcttccttcactactgagctgtaccatctgctgcatagttcattattccagatgtgtgtgatactagggtccaaaggagtcctgtgtcactgtccttgtcgtccttctggccatttctctgaatggagccatgtagtccatggtctttgttctctcttactctttctccctcaccccgcccccagcattggtactttatttaggttctcctacaccatgatctgtgttggtgctttatcccttttcagggctgcattatattccactgtctccggactgcattttatttctctgtgttcagttgatgacactgggtggcttcttgcttttgtcccctgataataaagccatgccacaagcttaggaatgagcagcgtttgtgtctctttagtctacacttgggagtagaattgctgtctccagtgttggtttttttgttttttgtcttgtttgtttttccccctgcatctacaagttcctggctggtttctaaggtggctgcactattgtatagtcccattagtgtcttgcttctgtttctcccttctgccatcctgttcagattcaaggagtttgtgtgcatgtgtgtgtgtgtgtgtgtgtgtgtgtgtgtgtgtgtgtgtgtgtgtgtgtgtgtttgtgtgtgtgacttttttgtccttgggaagaaggtaactgtctgttgcttgaggagttcgtgggagcttctccctagagattttgtctaacccggggctttggaggcatcaatggcctaagaacggggtgtgtgtgtggagggggaaggtagggggtgtcacctgctgctgacaggcacttgctgtgcaaggtctttgggtgttgccaccttcctcatgttctgaaagaggctccgaagggtagtgctctgcccagcaccacacacagagagatgaaggaagaagtgtgccagcctgtgagtgtagccaggtcttcctagggcttctgtgtgtagagctattgttgtactgcttcttcctagatactgctgatttgggctttggtcactgagccaccatgaattctggtgctttgatacaacacttggatcaaaagcaactttgggaaggaatgggtttattttagtttatatgggaagtctgggtggggacttgggcagaaacttgaagcagaaacaatggaggaacacttctttgctttctcacaagttcattcttagcttcatcatataacccaggaccgcttgcctagggaatggtgctgcctacagtaggctgggcctttctgcatcaattaacagttaaaccccacccctactctcaccccccccccaaaagggggggggaaatccccccatgccccaggacaattttctttaggtaacttctcaatttggccttttctctcaggtgaccctaggcagtcaggttgacaatgagagagaagtaggaaagtgaggggtctcacctcctcagttactgagtatttgggagccttggcatagcaacagcaaggtagtgaccatcttgctttgtgttctccagagggaggtagaagcttcagggattccgccttgggggcatcccatggcccagtgtgatctaggagggccctgtgctgggcagggaccagactggccaggtgggaggctgcacagctctgagtcacttgcttccttcctgctctgaggtgtcattctgagagctcagtgtccccgtgggctgggtttggtgactccagaagctggcttgccgcctgccattctgaagggcacccacacccatggctgtcaagggctccaatttgcagctctagccacttgtctttaatggagagggcagctttgcccccattgcaggagaatgcaagccaccaggtgtccttgtcccttcccaggatcagccccctgcccctgtcagatggcctcagggtgttacctgggtgctgagcctaggggggctcccctgggtggcttccctctaaggtgcagcagtgcccctcagtgtctaggactacagcttccgccttactccccaggaggcaggtaggggtctgtctgctgctgccccttgggtgtgggcgttccctttgctctcccatgctgagagcatgctctgctcctgccccacgctggtgctcagtggacttgagtgagcctccaccccttcctgccccagttgggctgttctccatctttgatagcaaacaatggcacactgtcagcacatctagaatgttctgggctatttgcacatcctatgaggcgggccctctgccctgcacccattttctaggtgaggaaatccagacttaggtgtcaccggagcccgagtccttgagcagtgcccatccacattggcatttgttttattggcatctggggaaacacaaaggatcgaggtgtggctgccctgggtatcaggaagctgcactcatgaggccttacagcatcctcagcagtgtcagacccctcctttcctctggtcagttatgcatcgagtctgactgcgggttctcttgttgccctatgccttcttcctcaactctgctagggatgcttccctgtttcaggctctgagcccacaggaggcgctgacccatggtttcttatcaccaggagagcagttgagcctggctggctgagcccctggtgcattgccataaggtgcaaaaactggtgtctctgatgatggcctggctgcaggtgacctgccttgtctctgagtaggggacctattggggaaaggatgctggcacggttcccacactggtccaagagttgtgtctgccacctgtagaaattttccccttagagccttttgtgtctctaccctacccagagaccaaggacatcatgagattccgggcagcgtgagtgcacaggaaggaaagggctcagaggaggcaggcacgggatgcagccaggggatacagagtcctcatggggtggagttcaggccatgggcgggtttggcaaccagcctcgagcttcccatctgtgtagtggtagcgactgccacacgagtaaccactctaacaaagctgcagccgcagagtgctaaacacctgcactcttgtctcaggcatcagagacctctgggaggtagtgggtagttttctgttctacctgtggccgcttcatgtccctcaggtaggctgtgtagggtccatatcttggacagaggaaatcatggcataggaggatacagaccactggtctagcctctgacatgcgacgggcctcctgaccactcactgttcttgcttccctctgaaactcattctcccatgtatgtaggacctggctcctggttccctgcagagggaacctgtagtgtcttcagccctaggccagcttcctctgtccagagcagaggccttgggtggtctcttgtaggccagtggggggagaggtcacttcttggcagttgtaactgggctctgcagaagctgtgtgtcggtgcctgccacctgctgccctcagcttcttcttcttgatttgtttgggtctctgtggtccagggtaagatgccttggtagcactagggctgtaggtttccatggtgatatagatgccaagccaaccctaagcgttttgcagataaactactttgcttagggtcaaggccaggcctgggccctagagccagctgcagccttttcctggccaggtcctgcttctccctgtgttctccgccactctcccagctatacatctgattattcaaccagtggtcagctgctggtgacagggctgcagggcctgaggctgagggtgcttggtctgggttctggctggtgatacttgtccaccacaccctgtcacccgtcccatccatctctgacatgtttcttcttcctctgcagcctctgtacaaccagccgtctgacacacgccagtaccatgaaaacatcaaaatgtgagtcactgctctggggtaccagcccattcctggggaccagaagaccagtgggaagtctgggtggaagtccctagctgcatcaagcccacgctgggctcaaagcaggcctggagcagagggagtggcaccttgcagcttgggtacagagactggaggcaggaggccatggtgtgaagagacaggctatgcagggcacagccagctccagtactcttagctgtggactgctctgggcacacacttggtatctgaggtggctcgaagcgctaacccagaggcttcacgagccgcatcccggtcatgggtcatttcccaggtagaggttgggaggagttaatgtccctttggttccatacagtggtgttcagcagggatatcaggctgggctggtgtctgatagctggcacccttaagctggaggggatacgtagaatggctgtaaggtagctgctagcttcctgggattttcgaatagcagtagttcctgtcagtgggctgtggaggagacaactaacatccagaaaccaaaaggtgggaggggcctgaagcacatggcagtgtattaggtgggggagggctggaggcaagggtcttagggatccagctctgagtggtcaagtgtgcaaagatcctgcctggtggtattggagcatgggctggtgaactcagtaggtggtgatacagtgatctggtagctagtgtcccccttggttctcaagtgttacaagtgtctcaggaggcctctggcttttggagttgtatgatgtcccaccctggctacctcctgtgttccctggaatatctttcctagctaaccttgagggccctgtactagcagtcagtattgggtccagctgctaccataggctatggccccatcaccgccctggacttgagtctttctgcttctctgtgtggggcacgcccagtggccctgatccccatggggagatgaattgcaggagagggatggatgatgacagctcattataggggtttgtcacagttgctttgtggggaggggcttgtgccaccaggccaggttactgggacattcatttacttattcattagctcatttactccttcattcattcatgtgttcattcattcattcattcattagttcgttcattcattcacttgctgctgttgccagatcctatcctcaccccgtggagtcaggacagacgaaggcttattccctgtttgggttgacaagtagctgagagaagtaagggagaaaatctgctctcccggggctgccagccctggccttcacgtcgtgacactccttgggtgggcttcttcagtgtgttggaaccaacaaggtctcattggatggctttggctagcctggagccttctgagtgccgggattccaggatgtgctgtcacagccagtctgacgtagccaacgaccgtatagcaggctgaggattttgtacagcgtttgttgcttaaagtgagtgatgttcgtagggcgagtcatgggatgtttcagcctatagaaacagtcatggatctaagccaaagagatatgtgccccagacagtgtagctggtgacattagccatagctaagctgtgaccagtgtcacctgtgttgaccaaggctggacttggaatggatttcttagaagctgaatctgtctgggcatgttggcataggcctgtgggcccagtgctctggaggctaaagtaagaggctggtgagtaaaagatgtagccagggctacaaaataagactagccttaaaagtaactaactaaacaagtaaataccaggaccctgaaagctttaaaaataagcaagcaagtgaagacagaagaaaggaaagaggtggggtgtgctttggtcttgagcctgtgccagttgtggtgaccctccagctgcaggattctagctatcaagtcataaatatggctctgagggagtgacctttcatacgtcaacagctagctttctgtttagtaagtccatctgtgcgtgcagtgtgagctacatcatgcttagagagtgctgggccttgctgtcagcaccattaacaaacatcacggccaccgttgcccattccagcgttacactgttaaatccacacagtctttcactgtgaatgcatctcgaggggagagtaaatggagttgtaggagagagggggagagggagtctggctagagaccggggcaggatgtgctgggagaagctggagcagctgccgggctgtgtggagcatcccaggcagatgggaccagcagtgcaaaagccctggggctgtgctgagctgcatgagattgcagactgtcgcagccacaggcaggatctgtcaggcccaggagggtgctgcttgtccttccggcttggtcaccgtccacaaagattcggcctttattgtgggacgtgctctgctgcgagtttatcttcaagttcactctgatggccactgggagaaaggtcctgggacaccatgtgtgggaaagccctggagagctatgggctgtgaggtatggaaggtcagggtatagggtctagggttcccagcccagggctggtagtatgtggtaagtcaaagctgcctcttgacgggtgccatcactccctggggaccaagagcgctcagctgtggccactggctctatcagcagctcctgaccccattcctgctgtgcaggtgtggcctgcagatgagtctgagggacagagaagcccagtgctgggacacagcggccctgacaacaatttagcagcttttggatagagcttgtatacagtttacccttttaaagtttgtctggtggatttttcatggtcacttaggtgtgaactgctcagcctgggctcctacagcacagcatcagggaattttgtgtcttttcgtttcttccgaagggtcaaggactcctctcgtctttggccttttgtgtttcggatatttctcatggatgggggctgggctttcccaggggctcatagtcctggagtaggtacagtgggcagggtggggtgcagagaccaggcactgaaagtgtggatagcttcctctggtctgaggctagccccaaaaggatgctaggtggcatgccctatgacacaatgacactcaggtcctggaagctgcttggtaggcggggtctatgtgacctaggtgatagtgatgtctatgtgacctaggtgatgtgtcaggagctccaggcctccagggtggatgaagtccttgcagatgcctgggagcctttggggttactgtctaattgggtgaaaaagattcagaatggtcagcctcctaggggttgggggtcaccaggggaaacagaattccctaaaggtggagccaggacctctggagtcacgtgagagactcagctctgataaaatggactgagtagtgttaggctggggtgtgcctgtaatcccagccagacaaacagacaaccctcccccccccccccccccagcataaaactaacagtgtcctcagagctgctgatggaggtagtgagcggcccatcactgggaggtatgcaagtcaagagtctttggtttgacatgtgacaggcgggagatcagttgccgcctgccacatgtcaaaccaaagactcttgactgggaggtatgcaagctctacactgtgtgcccgttgcgaaatagggtctctgcaccacctgtaaggtggggctagccctggaaccaccaagggcccactgtgttaacaccgcctcagctgacatctgtacctgacgtgtgagagaggtgcttggggaatttgttgttctagtccctaagcacggagacagttatccctcattcctttgttcactgcacacacgtctctgtgtgtctggtctgcaccaggcactgtctgtccctgggagatagcagtgaacgagtccccacttgcagtggggagatgacaagctcagtactcacatggagtgtgacagctgtgacaaggacagtgagattgatctggggggttggggtggggggagctccaccacccagggagcagagccgtcaccagctccttggctgtctgctgtaattgctgagaggtgggaagtgtcccttccctggggacctggcccctgtcattttaatttctctgccttcgtgcctggccatgactttcaagttaatttcatgcttggcttcctggtgtgggtgatttcagacctgtggaggtcacctgtgcgaccctgctcgtctcccccgccttgctctgaaaagtgtcaggagtagctgaggttctgccagggcacctgccacctgggctgggagcctgccctgaccctgccacacagggaaggcagccccaagggcatgctggagaagagaggtgtgggagtgcccagattctgtaggaccgtcaggagcatccatgcctggatgacagataagtctcagagcttagaaagatggggctggacagctactaccccgcccgggtctctgccagctcgtagccttggtcctcgagtgtctcaggctcagaaggaggcatctctcttcctggtgtcctagacccaccctctcattttcaggatgggcaggaagcaggttactgggaacatgtctctggtcttgccctggaggttcagaggtgcccagtaatttctccagggtcacatagccaagcccgcaagagattcagtccacacctctctgcgtctctgacgacctcagacagtattgcttctcccaccagcaggccaggctggtcccctttgctgcagtaggctcggcctttctgacaccgtttgcagcttgaacagacatgggtggggttccatctaattgtgccctggtacagttgggatcagacccttcctgaccctcatctcatcccgccaagccctggagcccagcccccctccactgcctttctttgagtctatgtttgtcattgctgccaggccgctgatttcctgggctgctcatgcaaggtctccctctgtctctccacccaagttcctgtattttgtaaggcagtacactaggattggtggtagctccccatcttccagtaggaggcggctgcattccccttctccctcttcccctcccctcttctccctctcttctcttgctctccctcagcctccgtatatagtgcagaataactaaacttctgatccttctgcctcctgtggtgtggacggcattttcatgtggtgtggacggcattttcacgtggtgctaaggtttgaacctagggctttgtgcttggtaggcccgcaactctgcatctccaccaagccacatctgaggtcacaggcatggggcatccaggccttcactccagggcaactcctcaaagtgggagctcttggtggattagggacctatggggaagttggggttccctcacctaaaaagtgatgcagttgtgagtccaggttagagagggcaagttcaggggtgtgatgggccccaaggcctgtctgtctgtgtctcccacaagacccagaggccatttgcagcgcctggttgagtgtattagggctgtggggagtagggatgtaccgggtctctgttgctcagggctggggtggatggagccctgtatcccgattctgctgtgccctggcctcaggatttctgttccttctctgcagtctgaactttgtcctgtctgcctgtgtcttttttctaccctccacctccatttcccaaatctttgtccattctgaggtaaatctctgttctcgtctctccccctcccttttacttctcccagtttctccctcctgccccctctgaccctgttcttctccccacgtctctaccctttttttttctcgattcctctccgactcccccaccgctttcctcggtagtccttgcagggtctcttggggcctatgtggccaagctggtacagtggagcttggctgtgtacccaagctgaagacccctcaatgccttagccactcataggacagggtccccaggccatagccgttgagatttgcctctgggtagcaagggtgggtctttgtgggttggtatccaaggctgtgactcagggggatgtgaatggtgcaggctttcaagtatgggagctctagggatggtgggttggggtactggcagctctgaggggcaaagtagactctggggaaagtagggggagtgggctcccttctgactaagggccagtgccgatcagcctgaactcctgctgagagctggccatctctgacgcccctgtctgtgccctccagaaaccaggcgatgcggaagaagctgatcttgtactttaagcggaggaaccacgcgcgcaagcagtgggtgagtccccattccgtcctttccgtgacatagaataaacaagcggtgacatagcaatgggtgagtcctatcccaatccctccatactgtgtgcaagctatgggtaaggctcatccctgacctgtcccctccctcatgtcttaggaaagcagtgagtgggtccccttctgtcccttcaacacatgggcgagcagtggatgagtcctgcttccattctgctcttctctgagtccccaaccctatcccctctcctccattggtgcagtagatgaggccctgtgtccccatggccacccaacagtcagggcctcttcagcacatgctgtccaggctcagaggtccccatccactctgcagttggggatgggtgcctgcgtcatgagagaatgctgtcgatgagccacagagggggcagctgctctggtggttggggctcctgaccccctttcccagtcctctggagcggggagccactgaagccaagaagggtgtcctaagggcacccttaaatgctcctcatgcccacagaggttttagagagtgacagaaactgggagtgccccgagaaatgagccttcccctcccctagccaggcctaggctctggaaaatggtaccattggaaaggagcaaggcccctggcgtatggtggtcagtgctaatcctgcttcttgagtttgggtgaggggtgcaagggacccccaagcagttgcactttgacccacagagatccagggctaagggatggagggcaggtaggtacctgccgtgtcgccttagctgccagggttgggagtgacaccctaccatcatgcctacttacatagtgctggaactgtgtggctggtttaattaggtcttccctctgtgtcttcccttcccttcctgggctctgcatgcaggctctgcttagcctcgatcccatatcagctcagaaccagggtcaagcttttgctggaggtgatgtcatttattccactcaagcccagggctgcagggaaacaccgtgtgggggggactgggggtgggggtggggttggggtctgtgaagtcaagatggcaggtcttctgcactcttcctgggctgtcagatgtggctgcaaggtactccccaccttgttcctcgggctgacctggtacttgcccagcaactcagcggtgcctagagcctgcgtgtgtgtagtaaacagaagacagcagctaagtgctgtttgcgcagaagtggaatgacgtttgaattgaatgagttgtgggtaaagagacagggagtcccccagtcataggtcctcagctgcaatcaccaagtgcccactgtgcatgtggctcctggcatgggattcgagaaccgagttcaaggctcaacttcccaccacagccgcttcctcctccctcggtggacatggtcccaggaggtggttgtgttttccagccgcatatttcaggcagggaagctgaggccaagaggttagcccattggtcccatgtcccacagagaagtggcaatgtctggattggcaccagggctgccttgttccttagtcttgggtaagcaaatcttgccccgagtagttcgggtgcaaggtgaggtaccagatgagctcaggaggggaaggtggctgaggcagtggaggaggaatggccctgctgaaatacaaggagggagaaagggcaagtgagttgtgtgcagatctttgctgagggagagcatggcaggtgtaaaggtcctgggattggcgcttgataggactgttgatgtccatcctcacagaggagcaccacgtgcatttatgatgaatctgcccttagtatgggatgcggagtgcgtcggtctgcaggaaagagtgatagcggcaggagagcacccttgctctaagatcaggcgggtcagcgccaggatcaccatgcgcagaccacaggaccgcaggcccctcctgctggtgggtgaggagaaggcaggcgttgtggtcccctcaacaccctaaaatccagtcctgccaccccaatgtgccacccctagatgccacccacagcttgccctgagcttctgccctcagccggatctgccattccacgtcagaggtccttggggctctgcagcctaggcagtccaccttagggagggaaggagagagggtctccatgctgcagcaggaggaagagacacgaagggctcaagagtgccgctctgttttctcagtttccagcaagacgtctccttcccgctcagctcagccaccccgctctgtcttcactcagaccccagggctgaggccattccctgggagcccttggtgctccccagagagaagcctgcctcgcttttttctgcggggccaagtgtgcaggagaccagtcagccacgttcctacccagcacaggccgacagacagagatgtctgcttcctcccctggccaggccccctctctccctgtgagcaacatcccactgtctttagacagtggttgtcaacggatcctagctccactgtgggccagatgcacacacctccccagtagatgggacagactgcagcaggccacgcggtggtttgatctagtcagagactgtcccgtctcagacagtaccacacctccccctcggaagctgcttgttgggcctttgtgctattgcctggggctatggagcatgtaggacgtttctgaggtcttgggaccctgttgcttgtctgcaaggtctgggacagtcccagctctcagctggtatctgacgttagctggtgtcctctgctgtctctggcctctggtctctgagtgttctctttcttctccctggtcctctgggtgggagccaagaggcctaggctggactggtggagtgtgttttggggccctctagccgtagccccccatcttccctcagctggagtccaatactctgggggctgttgttcaagacacagacacagggagctccgggtcagaggttaagtacactgtggccggtatcagggcctagaacatatccaaggtgttatatgaccgagtctcctgtcctgtggctgatagaggcgtgaattttgaaatgatccccttggatatacacagggcatgtgtctatgctctgggccaattgggagataaacagcaggcagcttggtggttaaatggggagggggacttccttatcctgcagaggagggcagaaccttcctttccaatgtctgctaggttttggactcttagatttggggagtgtggctgcaccagagaccagggatgaggaactgcctagaaagcggatactccctggggacatcttttctgggccacaagagctctacagagccatgctgcccaggacaacttcctgcaagtggtggggcctggcctgatctcctgtgcagtatcctgcagtgtcggtagccggtgtaaacacagggcatgagccccagcctattggatcagggctgtttctcatttggatgtgtgagcgaggggtaacttgatgcagctgagtcagaggaggcccgtgcagaggaggtctggctctgaaggagtggtcagtcatatcccatggggcacctttggcttcccaggggccggcagctctgtgactgtgtctgtgtgtgtgtgtccatcccccacctgtccatgtgagtgcagtgggtagtatccagctctcaccagcatgccgccttctgaccatcccccccaccccccatcacaggaacagcgcttctgccagcgctatgaccagctcatggaggcgtgggagaagaaggtagagcgcatagagaacaatccgcgaaggagggccaaggagagcaaggtgagggagtactacgagaaacagttcccggagatccgcaagcagcgggagctgcaggagcgcatgcagaggtaagggcacagccacagctgaagactgtgcgcgcaggggtgagggggtgtgggcctgggggcgggggatgagcctatgctcgggagaccacatggagggatgagtggatgctcaggggaggacacagagatgagcccatgtaagaaaacagttgtgcatagaggggcatgctgtgctggttcccatgggcccctggtggcctctgccacacagagtgccctcacagggcttcatacttacagctcgggaccctcagcacctgttgggcccagagccatcacccatgagtattatcttcctgtcctcactgctcctaccccatacctgctaaagctgccgagtgagactctgctggggtgggagcggcggtggcggtagtattgggagggtggctgtgaggtgggtgcctgtcctcattgtggccatgagggcagaaacctaggcaggctctctttagcaaatgaggctagttgggtgtggtcatctgcactctaggctcctcaggcttgtctcaatgacgacctactcagcagcctgggttctagggctgacctgaggcccagaaacctgctcctggttctcgggctggaggcagcatggagctcctgctgggtctcttttgtcttttgttcatgggagatgggctgccatcttatagccttgggagctgacattcctgggtggctccccaaactccctgggctcctagcctgtggtcagttgtgaaggtgggaggctcggccctgatcccaccctccccattcacccgtacataccctctagaatgttctaccccatggtcttgacttagcctgtcagtaggacggctggtcctgactgtgtccctctggtttccagcagggtgggccagcgtggcagtgggctctccatgtcggctgcccgcagtgagcatgaggtttctgagatcattgatggcttgtctgagcaggaggtaagtccacagtgacaccacgcacaccctgttgcctctgcacgtccctctccctgtcccttacacatacttcttgccacagtgctcaggtgccagcaagaagggatccagagactgctgatgtgtcagatgcaatgtgggcacgccagcaataagtgaccgcgcctatctcccaaagggcagagttgacagggatgccagcaaaccgtggggggcagcctggcaggacatagttggggaagttctctgatctgaacagtctctagtgcccaaagagacatcgggaagctgggttgtgggacagggataagtgccccccactcttctcctgctgccatggttcagggtgtctgttgagcttggcggaactcttaggggagtctgggtgagagtgggtgggcccagctgaggactgtcccaaggagcagccttctggctcattgccccctcagtcctccctgggtacccagtggtaatcttggtgaccccagctatggtcaccatcacagagaaggccaggaagcagaacaggtgcttgtccccagtgagggaccattctgctctctgggccaggtgtactataatgacatttgtccccatggccggcgccacagtcacccagaacaccatgtaccaggacccttgcttctttcctggtggctctgctcttggtagaggtggccatagaacccatgtcccctctgagccccttgaggctgtttatgtggagactgaagatgggatactggacagcagctggcgacacctctgtggctgtggagtgactatttaagctgttctccaagctgagtcctggtcctcgtaacactggccatggaccaggcgtggccgtttaagtggtctccttgtacacactgacagccccatgcacccagcagccttagcagctcaggacctgcaccccactgcagtgcctggccttgcagggacatcctcttgccagagttctgctggaaaacctctcctcctcttgtggacagaaagcagaactcaaaaatccacaagcgatagctacggggccatccttgctggtgggcatgtggctggggtcaacccatgtctcaccgatgtggatgcagacgtggctttcatttcctctggaagcagggagacagtggtcctgtccacccacacattggacccttccctaggtcctaaccacacaagagtattgtggctgccacctcttgaggaagccattgccagaacaaggctggagacagagccagaaccagaaggtgctgggcaggagacacttggaaagtccgtagtatcttctcaacatggacgggcaaggcagccacagaaggaaggacagggctggccaagtccccaggggatgatagaaaagccagggtataaggtctggactagaaagtgaccaggtcctctgcataccttgtgctgccccctggatatctggccttaagccagacagacatgtgccatcccgagagtgcgtggagccaggctgggctgtgccttgtccctgtcttcacggtgttttattacactgcctttgtgggggtgagattcacggcctctcctgctgcagataaggcctcatgctgtgcactgaatttatagcccttactgttcttaaccactccacacccctaaatcctcgccagcgccagcccctgctgccttttaattcctcatccctccccccaaggaatgtccaagggccagggcacctgctcctcacctgccaggccctgagcttgccctctgacccccgaccctgtgctctgttgcagaatctggagaagcagatgcgccagctggccgtgatcccgcccatgttgtacgacgcggaccagcagaggatcaagttcatcaacatgaatggactcatggatgaccccatgaaggtctacaaggaccgtcaggttaccaacatgtggagcgagcaggagagggacaccttccgtgagaagtgagtgtcatcctctggggctgcctgcgatccttgcctgcatcctctctgttcccacactctagtcccagggacactgtccagaactctccctgctctggtggtaccgggggcggggggtggtggtcctcagcctctctctctctctctctgcctccatctccatgggagtcatttgtttcctcataggtaatagatggatctccttgtcccccttagcattcattcagccagacagctcctgccacataggctcagcaaggggaagatgcctaacagggacccagagctgcatatggtggaggccgagtgcagctggctagctaggatggagaagccatgtggggaagccagggcttcagtgatcaggaacaggctgaggttgaggtccttaggagctgatgctcgttgcgtgtggtggccacgcctttgatcccagcactagggaggctgagccaggggcatatctcttcaactaccagcccagtttgatctacacagtgagaccctgcttcagaaagtgggtctccgggaggcccctccaggacagtttgggagagactgtagcttctgggcggaagaaagaccattgcagcccagggtgaggaccagaggtctggtctgtctccaggtagaaagagacatcccctatttgggggaactccaggagaggtggtatagatgtcacgataatattcgtatgtatgttatttggagcagtactctgtaaacacttcacctagaagcagaaccccttcctcagagaggaccaggacctctgagagactggacagtagaaattgaagctgggacaggagccgccatgttgcccaggagggtctgtggagaggaaggtttgtgcctcaggcctccagtgagcagagtagctgacctgttgcccctctggagagacccttgtctgccccagagcttttccagatgtctgctgggacaacagttgttcagggtcaggctgtacctgcccttggaaggatgctgtacaacaggctggccccatcccagatcacagacaaaacttggcagctgtacggggcttgggcacaagcgacagtcttcaaagtagcttctggccatggtaacacacacacaaatcctgagtctcatattcctagcacagcacagatagtgggagacataccataccccgaggagcggctcctatgggcagctcgggtcagggtctccatccttcatctctttgtggcctgtatcttgggctcttgcatctaagactcctgttgtctgtctggtgtgttttccgacttgactcaagatagtggtcctgaggtggctgaggccctgtgccctggttccctggtggcctgctattttaatgggtgaacacttaggggtgctttcagtggctggaccttcctaggaaagtctctttgctcttcagacccagtgatttgctctgataattccatagctgacaacccgatgaccagatgtctactggtgcctcttctgtctacgcaagacacagccatattatgtcggtctttgaaggatgatggtctgtctccctggagggctttcttgccaaggtgctgatggcatcttgactgacccgagaatagcgcagatgtcacccacagacatctcagctgcctcagtttcctcctgtgtaaaacagacagagctatatagtattctccttgggcctgcggcagctccaaggcagaacagctcagcataggccctgctcttgtgggaagcagtctggtactgctggcagccactcctgccccaacaggagaagctaggataccccatctcttctgtaaaaaggtggtgatttgcataagacctgggtgtcctccattcttatcttagggccagtcacaataccagatttaaaggaagtccacatgagcagtcattactcagaatgttttaggggacactatctcaggaaggccaaacaaatatggtttgtacaggcccaggtggtgcatgtgtgtgtgctcacaaatgtgagtatgcgtgtgtgtgaatgtgtaaaacttttgttgcttgtctttttttgaggggagggggtagtggttgctactttattttctagagtctcatagctcaggatagcctcaggctcattatatagccacagctggtcttgaacccccctgcctcagccttcccaatgctaggatcatagacataagccaccgtgacctgcccatgttactatttttaatatatattaggaagggcttttttttttttatgtagcacagacttgtctttgaactctgaaacttcttgcctcagcctcatagtactggtcatctaggcgtgtattgctatggttgacttcattttggagccttactggcctgcgatcagttgaaccttacatgtacaaccctatacatgcgtcctcagcagcagcgtgaagtgcccaggccaggctgaacgcaggacctcatgtgggcctatctcttgataccactgagcctcttgttttagttctcagatgaggtctcgctaagttgccctgcttggtttgaaactcacagtaccccaggctggctgtccacctgcctcaggctcctgagttgcccagttacaagttgtatcatcagacctggcttcgcctgtctccagtgaactgtgctgggaagagggacggggccctgcagtgtcttaagttaggttcctggtgtcctgggacccatcactgcctagggaaatgctagtggtaccctaggcttgcctgctatctgggtggacggggccctggaagggtagccaccatcctgccaatctgctacctctgcttccttgggaagagtctagaggctcttccggattccccagtgtctggcggggagaatgggaggggcctctggacttctgcccagccacctggaggccaggcgggggcagcccaacacagactgaacactggtgggaactggaccagtactgctggcagccatttcttacccccacccccacctaccctgggacatactagggtggtggcaattcattggagacagggggcaggcccaatgacgccacccagcacccttagggtgtgagcaggccttgaccctatccccacccccacagctgcctggccctgacatttcagctggccggctttcccagtaatgcttgggcttcgcaggaagctggtggcttggcgccaattcccgccaccccctgcggctccagccacttttggcttttcctgggcatccgaggttccgctccagcactcaggaggcctcagtgcctggcttgtccaacctcgcccaggcaggcttagcttggcataggctgggcctggctgggccgggccaggccgagccaggcccagcttcttagacccggctggggagagagacaaaagcatatctggggaggtggggggaccccactggcaagctgaatgccgtgtcctcatttttcctggaagcctgcggcaagacaaacaaatgtattttcaaaggcattacagccagtgagtcactcggaggaacgccctggaccctggtccctgccccgaagcccttcccacgccctgaagatctgctagtggggcggcgcccgccaagccaggctggggtggcaggcactgggcactctcagctcttgattgtcccgtagggcttccctcagcctcagcctggcctcagcattggcctgtctttctcttccccccaggtttatgcagcaccctaagaactttggcctgattgcctcattcctggagagaaaggtgagtgccatccctggctggcagagctgggcactaaaccggcttgccatccactccttagggccgatgtctgggctgggtggagcgcttgcccctcctctgtctctctggccagctccatcctttttcctgcctccacctccttcctcagggggaaagccaggcaggccccaccctggatggggaggagcctcaaggcttcaggcccaggccacccaggaaagctgtagggactggcatcacacagccatttgcccagcacactgggttgggcgccggttctaagagttttgccacgttccaactgaggccttgtggccaggaatggcctgcatccaggtctgtgtgtggagtaatctcctgggcccttgtcatgggtaatatgggttttctgacaactctagataccactacttccggtgtgtggctaacatgtctatcattctgaacaaaccttcatgcagaattgatatttgaacccaacctgttccctaaaccagagcctgaaagcactctcctctggctctgtctctcgtcggtaaggagttacattgtccccagagggcagttagctggctttcacttacataccaggctagcctacagtacatgaacaacccgtggtgggcaggtggcagggttggctgtgtgctggagttggtcctgtaggcccagcacctcagactaccagggcccacccttgtgggctgtagttggtgtctagaccctcaacagtgggatgtccagcctgcctggccccctgccctgagtctgcccagggatgctggcagctggtgggaggtgggacccgggatctagacagccgttctcaaagaccgtgatcattcctcactgttccagtgggctgatacggtctggagagatgggaccctctgggatctgggacctgaagaaccagtgttgggaaccagttatagcctacctgtctggtgatgccaagcatcctgatgggtatgggtgactcagtagctctaggtttaaggctagggctccacagagccaggatggctcttaaattggtggttgagtaaggctgtgggggagggaggagtggaatctgagggcgagaggcgctcaaagagggtgtagatgaggcagatcagagcttctaggacacaggtggctgctaaggccacatcaccttcctgggctggctggcacgcagttcctccggtgggtcatgggtgtgggcgagggttggcttgggggaaccccatggaaatagtgtttgctcatggcatactccaggagtgtcctgatgtgtaggcagctggggtctgtcccaccccgcagttctcatggtccctggcttggcactaggtcaaatgtgataggcatggacatctcagacacggttgccactgcaggtgtccattgaagcttcttgtccatgacacttaaattctgggagaggttgttcaggatcctggatgttggggaaggagcccagagccatgggtggcaaaggctgggtttgtgtcactctgagtacccgcgactttgttctccacgggagctgagcggctgtgatgtcatcactgttacctacagttgcaaggacagggtctgtgttgagagcctgtgactctaccgcctgtctctccatgccaggctctgtcccgtgtgtgtctcattcagaataactcccttgaccagcacaatctgtttctgcatggcacaagcaagctggtgggtattcagagaagttagatttttcccagggcaacccagcttgtcatcagaggaattaggatttgaactctggcctctgcctcctactatgaatcctctcaccccgtacaccccatacaccccatacaccccatacaccccgtacaccccatacaccccatacaccccatacaccccatacaccccgtacaccccgtacaccccatacaccccgtacaccccgtacaccccatacaccccatacaccccatacaccccgtacaccccgtacaccccgtacacccctcagagtcttctctctgtctctcagacggtcgctgagtgtgtcctctattactacctgaccaagaagaatgaaaattacaagagcttggtgaggcggagctatcggcgccgtggcaagagccaggtaagatgtagtgtgtggctgcttggctttgaggatcaggtccctgcacttgagggacacttgctgggtggtcagtatccttgatgattggtgtcatatagttctactgttagggatccctctttagcctctgacctgctgagggtgttcgcagaggcgggaacagcagccacttctgtcttagctaggatgtccccggttcagagttggccagtccatagtccttactgttagaaggccacatgtcagagctggagggatagctcagctataaaagagcattggcttgattctcagcacccacatggtggctcataaccatcggtaactccagtccgaggggatccagtgtcctcctctgtttgcaatggtatcaagtacacacacggagcagagaatacccatacacaaaagtggtagccgattttcaaagtaaagactgctcaggacaatctggggagttctactaagctttcctgactgccccttcactagtggatacgtgcagggagatgtggccagcactctccacgtctatgtcatcatgccttggtgtctagagtgagcctagagtgccagccactggcgacttgaagttctgctctctgcctactgtgtaaataaagctttattggcacagagccactactgcacagcctgcagcctgcagcatcactgctcacctttagcaaaagctggctgatcttggaagatgttaagaaaatgcaggcaacacacagaagcgaggaattcaggggtgtggcctttgggaggtggggagagattatgtgttgttcactttctctctgaattgagttgaagcatcatggccagggactgctgtcccacagaacaggcgttttctggcccacttacgcaaagtgcagatcgggaggtcaagtctgcagagacaggcgaggcaccccagtaacaatgccctgaaagttagtaaagtgcctgctatgtgagcaagagaacctgaattccatccctagagccacacactcgtaatcccaggggaagagaggtggagacaggacactctgtcttgctggccagtcagcctgttaatcgacaagctgtagcccctagagagactcagtctccaaatacaaggtgaacggctcctgaagagcaaaacctgaggctgacctctggccctccgtacacacgtgcatacaggcacagatacacacgcatgtgcgcatgccctgggaaatacccaggacccagtctgtgtccactctggacttgaaagatggctggatttggtctggggctgtggttttctagctcattttatgcgcccacagtgagctggctagcttatggttctgacagatgtgtgactccgcagtgttgtggcacagagcagtgggtatgctagaggtttggctggggtattcaggaattttctaggcagtcggacacacttggacacctattggcaagtgtgatgaagctgggaggcgtggtttatggagacatggggccctgtgtaaatctctgcacctagccctgtagggataagtgggggaatgctgctacctgccgtcgggatggttggttaatgacggtgatgatgatgatggtggcagtgatgatggttctggtaataatgctggtgatcatgtctttggtgatgatggttgataatggtagtggtaataatgttggtgatgttggtgtttgtttggtttggtttggtttttcatgaaagggtttctctgtgtagtcctccttcctgtcctggaactcactctgtagaccaggatagccttgaactcggagtgcattactgctgcccagcctgatggcgatgttggtgatgccagtgactgtcttagtgacttttctgccactgaggtaaaataccattgcctaggcgatttacagaagaatgaatttacgtgggcttcccattcttctcaagagttaagagtccaatgccggcagggaggcttggcagccagtggcaggtggagcgttcatatctagaaccacagcctccaagcagggagaacaaactaggggtagcagttggttcttaaacctcagagctcgcctctggagacaaacttcctccaataaagccataactcctaagcctccccaaacagccaccagttaagagtagccatgtctcatgcccgtgaaggtgaagcagggttcttggtgattccctctctacgtaagagagctgggatcataactagctaaaggagcatccacagggtcagactcactccctaggctgtgcgagctgagggaggacgattgctctgctgggatcgttgggtagtggggccctgcctgagatctctgctcagctgtactgccgctgggcctcatgggaggcactgctcgctgggcctctgtactctcgggacagtttgccaggctctgtgctgtggtgacatgccccgaaacagggctgagggtggaaagcggctcctactgaggatatcctttgagacagagcaaggcccagcctcacccagtttggctctgtccttttgctccttctgatagctcctctttcctggaggaggcgtgcctgtccccagcagctggtagggccggctctctacccgtttgctattttggtctctccctttgttcctcatcccctgctcggggtggcccctgtttgtagatggctctggtgtctgtggtctcggtgtggctcctgtggctcccggccacactgttgcttagaaaagccacaagtggccattctgcttctcggcacaccaggtgccactcagagggctcctcgagagatgcctgtttggtgctagatgtgtgtgctcatttgggaatgtattgagcgcttcctgcatgctgtgattggagaaccattgtaggggggtccgtgtgtaacagttcagaaagacactgggccttccaggatgtcaaccctactctcagactcacgagggaagagttgcaaggtagacaccaggtagtactttctgcgtgcttaaggtcccagttgttctccaccggctctgcatcctgcgcaccacctcggagcagctgtgcctcctggactggctgcctccttgcccagcccagagactggggactcctctactctcaattctgccttgatgggattgagccaagagaggagcggaggcagagagccgcccctaagaacacctgggcatttagcgtccagctctctctgcacgcactgggatgggcatcggtggagatgtggacttccaggttaaccctcctccggttgctagcgtgtccggcccaagactctttggttcttcaaaacctgttgttagtggagtgaccccaagaaagtcaaccctgggtccagcacccaaacaagtagggtagtgggaaggggaggggagcttcagacccccttagggccctttctggagtgtccctaaaaaggttgagatggctatggacaggtctcttggacgtgtctcctgtgtgtgtgtctgtgtcctccacttgccctgaggcatccaaactggcctggcccttggttagccacctctgccctctctgtcccccacctgccctgtgtcagagcgcttgttcaggggtcatatataaaaaaccacagaggttataagcccctcatgacagtcattgggtgtcagtggcggccactagtgtcctgcctcatctctcagcccacccggccaagaaagagagaggctttccccgacctcagctgcccgtgggtgaggagtgtagctggccgtgtggagtggtagacttgcttgttgcttagctatcaggctagctcccattctagaagcttctctggcctttgcctacggtgaggcaggttcaggcataggctctggggacagtgacctcctgaaccggttctgaggaatgggttcaggaccatgttctggcgcctttccccaagctgtcccattggctaatgggcccgactggacgtcagtctgatgacaactcctggtccctagcccagatccgccccaagaagaatcatgggctgtggtgcctgccacacagggtgacattctaagcccagagcctgcagagatgaccagccatgaccagttggcagatgctgtggccctcctgtggtggcgagggatctatgaccaagcaggtgtgtccctgagggtagactagagctttttcctgtagaggcaggacatgagcaggaaaagtctgtcctggactcctgacctctggaccagccccttttgctgagggggaagtctgtggtggaggttcttcatcctcactgatgtcagccctcacatcctggcccacggtgttctgtcggctgccccctgaccttcttctgtcacactgctcttcctggccttggccacacatgctgctcagactctctgccgtgggtagcttcctctttttcccttttcctctgtgtggccctgtctcttctctgtttctgccgtgtgtgtgtgtgtgtgtgtgtgtgtgtgtgtgtgtgtccatccgtctttgtctctgtaaccctgtacaccacctcctttttgttcctgtctcacctcttcacccaccttccctgtgtctgcctgtctgtccatctgtctgctggactgccttcttagctctcttttctctgtgaccccatgtcacctctctttgtccccaacttacctctttatctactttctctccctcatcttactactttgctctggttgcttgccaagggacagctgaccttgttcccaggcagggcccagattacctgttcaggcgctgtgtgaccaggaggccccgggcagcaccagacagacttgggcagtgtatggctgtcactctcccttgaggaccagctaggtaccccttgcctgtgaggtaaccagagactgatggtcggaaactgtgtgtcacactaagccacagtgccctggctaggccatttggttgttggtcatcagtgagggggtgtgctatgcctcagaccttagtagtaaggttccagcctaaggtccgaaacttcttggctgcagtccatagcgggctgcctggctgctttactgaggatgttctgtgcatggcagacctgtgccgatttagggccagctgagaaggcatctccagttccctgtccggctccacgctgagtggggaatctcctcagaggccctcctccaggtcccaggtctgttagacatgccttgtgggaccctactcagggctggcagctggggagggagcccaggaggcaggagaggctggaccctacggctggaaggagctgcatcacttccatgggaaacgagaaaggttcaagactgggccaggatacacagcacaggggacccagctcccccaaccacccaaactgccttaaggtgggaagtgtgggtgctgctggacatagtccatcactttcctgagacagatatcaccccggtgctcctaaatgctatttacggctaactagatcagtagcactgggagccacccgtcagcaaaggctcatcaaaggtcagcatggcttcactgtaatgagacaactgaggtccctggacagccacttgtggaggactgctgaagtcctgggggccatgtgatcaagagtagctttcagggctctgatcccttgaaggaacagatgagcaataagaaggaactgaccaggcaaaagacacagcgggtgcaaaggtcagaggaagggactcttcttcggtcgcctctatctgagagcaggagggaggcaggagcaagctaacatgtggaggtaggtccagcctggatgtcccgtgtgcttattctggaggcagggcaaggtgtgtgtgtgtgtgtgtgtgtgtgtgtgtgtgtgtgtgtgtgtgtatgagggagagggagagggagagggagagggagagggagagagcatgcacacgagcaaccttccatatcactgtcaactaagaaaatggaccacaggcttgcccacaaactgatgagggtattttctcagcggagattccctctacataaatgactctaacttatgtcagtttgacattaaactagccagcacacctgctgagctcccccagcccccagttgaggatttaaaatggggccttgggattagtggtgcagctcaggggtacgacccttggctagcgtgtgccaaagccaagggctcagtcctaagttctgtgaattaataagtagacaagccattggccaccatgaacggactcctgggcgtgtgtctcacggtactcagtagaagtgtctccacaccagagcagctcgggaaagcgctatcagttaatgctgggagccaccatggtgtgtatgaagtgctactgctgtcatgtaaattcttactcctgccaactctgactcaagcctcagggttgcagaagcacacactatatcctgttcctgctccaccatcaagcagtgggaatgacttcacagtctaggctgcctggaccacagcggccatgcagctgccccttggagaggcaccacatgactcagcccctgatgtctgtttaaaagctgatctctggcctggcatggtggcacacacctttagtcccagcacccgggcagcaaaggcaggaagttctctttgggtttgataaaggcaggaagttctctttgggtttgaggccggtctggattatatattgagctccaggctaaccagggtggcatagtgagaccctccttacctcataacaacagaaagccctgctctctgttaatgacagtgtgcccaggctttatgggctcttgttgttccacactctcagggaactccaacacacctctgctgagggctgagcctgcattccttgctatgtgtccctgggagagacacagagcaggcatgaagccgtaccaccagctgcaggctgtgttgctccactctgacccccagccctgttggcctccacccagccaacctctccccttctccacacaggaagctcttgcaactcacttgtggggtgtttgtcggtccttggtagtacagtgtttattgaatgagcgagtgtctgagtgtattagtcagggtggctgtgcactcgcaggttctcctttgtttatttaagtttgggatggaatccaggggctccccaatcccttcccttgatcttgtcctccatagagccctgaagacccagtgcaggggctgggtcctactgggcctgcttcctcatccggagggtctcagtgactcaaggccacacagggccatttgtgccttttgaaggttctcttagggttttattgctgtgaagagactcatgaccaaagcaacttttataagggtcaacatttaattagaggtggcttaccatttcaaaggctcagtacattatcatcatggcaggagcatgggagcgttgaggcaggctggtgctctagaaggatctgagtgtttaacgtcttgatctgaaggcagccaagaggagggtctggatcaccctggccaaacttgagcacatatatgagacctcaaagccccgccttcgcagtgacacacttcctttaatgaggccacacctcctaatagtgccacttcccatgggccacgcacattcagaccaccacaaaggttttacctttgccctccctctgcacctcagtcctgacaacgtcagcttcagaacatgttctgtcaggttgttctctatacttgtgggggtctcggcgcccctgtaaataagagtttgtttagggtaggaatggcagttctccgaactcggaggaacccagagtccctgagcaggctatctttggggatatctggctgtaggctctgctgggaaatgctgtgtggccctagatggatcgctttacctctctgtgtcttgttctcatctatggaacaatgtaatgtcagggttgttgggaggagcaagaagctggacctgtgatgtgagagcagtctcatcccatacatgtcgtcagctgacacctggccttactaccgtgggcttctgaaagaaaaaatgggtcctagcagaaagaacagatacctgaagctccctgtggatcctttcagggtgttcctagtgctgtgacctgggggtgggggacgtacatggtcaccttgcccgtaactgatgagttgtcactggatactgcacgtgtgggagtcatggggagggtggcattctgcctctcgtggctctccaggctggggcgtgcgtgcgtgcgtgcgtgcgtgcgtgcgtgcgtgcgtttccccgtatccttcctgccatggaatacagaaaccatgctggtttctcactgtggtctgaggatcttagcagcagacttgcaaggggctaggtaaacatgtggagcctcgggttagcctagagtcagcctatggccaaactccacctcccacttgcctttgtaaatcaagctttattggcatgtggccattcccatttgctcacacagtggcagagccaagccaggtgccttggaacctacaggctgtccagcctgaagtcctttagataagaacttgccagccagactgcaatgtgctggaacaacctgggaatttattttatttttattcagatggttttgagacaggatcttaccatgtagccctggccagcctttttaaaatttgctgcagtcttcctgcctctccgttccaggtgttggggtgttggggtcacatgtgtgcaccactacttgtgactaagctgggacattaaaaatattgatgctgcccccagcctgggatcacagtggccttggcacagttggggtctggcagcctttggccatcaggaagcacaactgcccaggaggctacaacaagcttgtaatccccaggtatggctggccagtgctaccagccagacgtgcagacggggatttgccagcctgaagtggttggtcacagggacccagtacctgcttcaagtctcccgggagccaggagtggccaaacatatggggtcattcaggccaaggcactgttaggcagaaaagtgactcgctggccagggcagcctaccgggcaacctgctgtcacccctgtccacagaggctcagcctggggtgcagagacaccatgtggctcatgccatgcacagccagatctgagtccccaactcagccctctatgtagaggtgggagacacagccaagtggcttgaatacaatgccccagcacagggcagctgtgaagtacaggctaattcctcccgtaccgccttctgtctccttgagttctgaccctcactttccatggcccaccttgagacagtgttgaactgacaggaaactccttcagtgtcaggttcagggggctctgtctgccagaatgaggcttcgcccctgggctgtatggagtgttagaatctgaagggaagggcacagtctcgctgacagacatctggtacccagccgaggagccagcaaccatgcatggctgccctgacccctccccttacagaacacaggattcttaggagctggagagaagtggccctgaggatcccgagtgcacaacagtgttgccttaagaggctacagtggctggacaagtcaggttcttgctctgtctctgtgtaccagtatgccatggtgtccgtccttccccagtgtagcctagtcctataaaagacaaggccctagagccattgtgcatcaatggttttctgccaggaaggaacaatggaaggaaagagtttccctacacacacacacacacacacacacacacacacacacacacacacacaaaggctttctgcagatattactcttactccactgggctcaggggagatggcaggactcgaacccctacacccgagtgtggtgcttttctggcttcattctacctccaacctctcccacctggctggctccccagttgccctggcctctgcgttcaccgtccctcccttccccagcttcacctgtctcctgttttccctcctgcctctgctccccgggctgtagcagcagcagcagcagcaacaacagcagcagcagcagcagatggcacggagcagccaggaggagaaggaggagaaggagaaggagaaggaggccgacaaggaggaagagaagcaggatgcggagaacgagaaggaagaactcagcaagtaaggcctggcagctgcgcggtgcacacctgggcccctggggaacagagcctggcgccagtttggagccccagtcagttctcccaggcctttcctcccggaagcctcagcccccactctgtccatcccccaccctctctgcacacccccgcttctcccaccccccccaagagacctaggagactgattgctcatttgagccctgctccgggactcataaatccagacagccactttggcactcagccttgcctcccctccaaggcccctgaggtccacgagggagagagggctgaagggcctcgggagggcaacatggacgcaagcatctggcagcccccgccttcatcctcacccccatcagcacccgccaacccccctagccagcgggagaaggtggaggggccgcaggtgctgtgctgggcctgtgcacatcagagcctcctccttccctgtctccacggctccagccggcatctttcaggaagatgaatgagtgacagaggcgataaatctaccccagttgcttctgaggagccaggtccccaggtcatgtgcacccccactgctgggctgggctgcaattccccacgcctgcagtcctatataccctgagcaaattgctctgtaggggtgcagaattaagtccccgtggctagtacagggggccacagagtcccgaaggcctctagctgggctccctgtttgtatggtgatggtgtcagcatctcttgaggccccgctggtgacaggtggagtcagatgacttcacatctgcccttcccacccacccctggatgagctcccgccacctttcagggttaaggtactgcggcaggggcctgcccgcccatagcacccttttagccagctgcagctctttcctctctgcagctgtgatggagcaacccaaaggtctccccagtggtcttggggtgtccatccccagctgatccatcccggtgtccctttcgtgacctcagggagaagacagacgacacttctggcgaggacaacgatgagaaagaggccgtggcctccaaaggccgcaaaactgccaacagccaaggccgccgcaaaggccgtatcacgcgctccatggccaacgaggccaaccatgaggagacagccaccccacagcaaagttcagagctgggtgagcaggctggggactggggggggggggggctggaatgtagggagattgtttcttgctaggattccgtgaagttggagtaaactgcccctagctgaggacctgggtctctgtctgtggggtttagataaagtatttggctaactgcgcttattgtgacccggagcgttctcccttttgcctcggtatcttcacatgcacagagagaaattatacacctaacaagaatataaagagaacctgggtgcaggccgagcttaggactgggaagaggctgtgaacccacctttccccaacccagccccatttgttgttttaaatcagaagattgggccgtgtggacatttggggtggtgatgaactgggttaagtcatctagtagaaggatagttctgagatggtctcttcacctttgtgggttttggtttcccttgccttctctgggtaaaaaagtaagccagtagggtgagctgagctgcagttccaagggcagccaccaggggcagcagtgcacactcatcctgtgcagtgagtgggtcatcttggctgcttgggtctcttcccaggttctatttctctagtggatctgaggtagactttcactcttcttggaactggcttgggctttatgtatgagctgctgggggcagtgtagcttacctcaagttatgatataattgggatttgaactcagctccgctgaccacaaatcctgtgtgggttttgtgggtgtgtgtcagctggcacttgatggcagagtgccagcaggcctgtgaggcagacctcatgtgtaagacagtcccatggcttgtactaggctgaaggacagaaaatacaccctggcctctctcagtgttccagaatcttctacctgtggcttgcaaagcctcccacgaaggtgtccgtggaaggacaggggactctgagatccaggagacagccggggcttggcagcaggaagggacacaggccacaccatgcctgtcacagttctcggcacacccctgtcagggactcacagctgggctacaggcagcaggtcacctaaggagcggtcagagtgtggtgtgtcatccagacaaggctgcctctgcccaccctgtgcctggctgcgtcccttctgaagggccttgttgtcctcgggtgagctagggagactgtaatagtcaccagcaccaaaggaggcctagccatggtgacgtcactcacaagccgagagcaaatgctgaggagccattttttgagggtcatggtaggagacgggctgtgagcgtttagagcagaggttctcaaccttcctaaggcctcaaccctttaatacagttcctcttgttgtggtgaaaaccccccaaccataaagttagtttgttgataccacataactaattttgctattgttatcaactgtaatacaaatatctgatatgttgcccctgtgggggtcacacacaacccacgggttgaaaaccactgatctagagggttgcctccaaggaggtgtgaaatggcccgctctgcacaatggagtccctgcccatgattcttcctttacatttgtgaccgtgtccctaggtgggcttaccccttcctggcaaagtgcaagtagaaacaggccatgacccagaccctggccacctgtttccttgtctgcgaatggagataccagatcctctcagcatagtgcgctgtggtgctgtctgtgtgtgtgtgtgtgtgtgtgtgtgtgttggtggtggggggggcttctgtacacagctactggcccctgggcatggggcatcaggcactgtggtaagggggggctggccagctcagagcagactgtaggggaagcactctatggaacgcctaccaatgcctgtcttctttgcagcttccatggagatgaacgagagttctcgctggactgaggaagagatggagacagcaaagaaaggtaaagcgacgtgatagtgtgcgccgtgtttgtttgtccccggcactgggatgcctggctcgcaaagctgctggtgcatctggccaggagcaggggctcttcagagcctcagttgaacctgccagagaacaagtctctgcctcgagtgctggcctgtacctgaatttagaatggcttaggagcctgtggtttgagtgtgcgaggaactacctcaactggtccctgaggacagtggccaaggtgcttggtggacagtcccctggccatcgaggctggccacagggtcagtggcacaggagggagggcttcctgtcttcacacctgcgtgtggctcttacatggggtctccaaggtccccacgctggtgcaggcttgtgctctgcaaacatttggaattggtgcctagcttttggtggtggtgtgttccacagtagaccagacagcagccataatagttgtctacatcacaaggccaagactatagattttcaaaatcagggagtcgttagctgtgacatgtgactgggctaagccattcacaccctgaggatgacatctcactgccaacaacctgctggctagacaggaccccttccccagcatctctctgagccttgacctttgaggggacgcctcctggggccctggtaacattagcatgacctgcctcgaaaccacactcattatgcctgaggccttcactctccagcttggtgacctatctctgagcctcagtttacccatctctaagataggagtgccagaatggctacaaggagttgaagccaccttaggatgagtggctttcactgagggtcccagagctagcgattgtgaatgtctggccctacctctcccatgtctctgagagaaacaaagccacctgctcacttgaatgtggcattgcagtgggctcctgccttagtttccacctgatccttctctgagatgtagctcccatttctgccccctgtcatggacgaggagtccaggctgaaggcctcccaaagctccagaggcgatgcccagtcctcttggctcccatcgttcacactctgctcagcccctgcccctgcccctgcccctgcccctgcccctcaggtgtggctgctctgcccaggctgcggtgtgcatggtgggaaccggtggcttttattaggagctctaacacacctgccaccactgccacctgcggctctggtcttcagacctgcttctccctccttttgaggggtttgccgagggtctaatgtacccagcaggagtgtcccataccacctgagagcagccaccaacctggaggatcctttaagtgctcctgcttctccacctggatgtgtgtctttcttgactgagccctctttcacccaagggtgggcttggcctgggggctgggccatcgctcaagaaggacagtagagatatctgttcacagggctctgagactgtgtctccagccggcttggtgcagtgtgccgtcaccccagaggggctgtgttgttctttgttttgtgtgtgtctacattgtggtttgtggtatgaattctaaaaactctttacgtaatggtctgattcccatggtttaaatctccgcaaagtctgtataacagacttgaccactgaaaagctgtctgttaacctgggcatcgtggggcatgactataatcccagcacttgtaaggcagaggcagggggatcataagtgtcacagtgagaacagtatcgtgttcatagcaagtgagaagccaggatgggctacctgagaccttgtctcaaacaaacaatacaaaaaaacccattcacctacatttacccacagtggtatgctacaagcttccacaccctagatggaaatcccgtacccattatcggtccctcctgcccatcagtccaagggcgaggcagcactaatggacttccggtctgtggctagaagtcattttgccctgacacttacaggaatgatgcctgctgccacaccagtccttacgcctggctgcactcacttagtgctgttttcagggttgttcgtgtatccatgagggctgcagggctacatgagccacgtgaagtgccacccctccagccaccccccccaacacacacacattacttgtgggctcacctggcaacagagtggtgggttatttctaccgtgggctctgcgtgtttctgtggagatcatgtgacccctttgcttttatccacacgtgggtcctggggtctcagcatcctgactgcaaagtgttcatggaaagcatccatctttgtccataccctaaagatcttgcagcccctcaagcatcctcctgcctccactagcccatagctgttgccagacaccaggaggctgcgctctctctctctctctctctctctctctctctctctctctctctctctctctctccattttggaagggcagatcagggtgggagggggggtggaatgactcaccagctgggatggagcgccctgatgccactgtcccaaggttagggcctatagggagggctgggagctcgtccccactgatcctgggggcccgtgtgcactggccctgctcagtgacatttgaaatagcgccgtgagcgctggcgcgggctgctgctgtgaattacagcaatctggacaattatggctgctcgcggtggctgctgatggctgttccggaggcgggggcggggaggcaggtgcgcacagcccgtggtagctccttttccacagcctgtgggggtgagaggctaagaatgttcccgagcaccctgccgagagagtgctgacaactcagagaggaaaatgaccccagccaagctgtgtcccaggcagatggtactcacccatccttggcccagtgcggggtagcagcccacagagaagcaggccctcagggaaccccaggcaggtaagcaaccaggtgtccccagagccaccggagcatcctccttagcccagctgtgaaggacatctgtagaagcatccagcccccagagcagcccagttggatttcctgtgtgtgtggtctagaccagtcactttcttcgtctatgtaactggtcactggcttcagcacaataggaaaatttttctctcccttgcccaggaagctagaggtgcaaagttgaagtgtgggcaggaccacgttccttccaaggctccaggggcacctacatcccacctctggtggtggtctcatgcttctggcctccttcctgtcatggccttaccccacccccacccgtgttcattaggatttcccttttccttctcttctcttttcttctcttttcttttcttttcttttcttttcttttcttttcttttcttttcttttctccttcccttcccttcccttcccttcccttcccttcccttcccttcccttcccttcccttcccttcccttcccactcagaaatccgcctgcctctacctcccaagtgctgggattaaaggtgtgcgccaccaccgcccagctctttgtagctttgaacttgaaaggtgcccgcctctgcctcctgagtgctgtgatttaagataggtcccaccacacatagccacagagtccttcttagttggcccaccccagcagattgaccattctggtccgttgtacggtctgtccctgtgcataacttctgggtggacataaaacttgagttgggactattgcccagctcagcgacatccaagtggctttttgctcaggagtcaataattagtcaatagctgaccttgacgtcctgatgccttaggcatttgggtaccttgctccagccccgtcaccgctgcagctcctggtctcatggtggcctccccatttcagcctcattgtcattttctctgtagaaagggcagggaggtctgccttccaggttcatcaacaggataggagccaaatgtttgcagtacttgatatacaggtgggtgctcaggtgcagactgcagggcagctcacaggctggattggagtcccaactccgcctcctttggaatctgccctgagtgggtacctatagcatgggctgatccttgcctgtgtgctaaggggtgggatgcaggggaatgacttgccaagatgttgctcagccacaagtgaaacgagcttactgtggaggcaaatgctttacacctctggcctgctttgaggcaactgctattatgcagataaggaaagaggcccagagatacatggaatgagctacccaaggtcgagtagctgtgatgtgaggggtctgggattggaacctgggctcttgagttgcaaaacaggatgtagtagtgaggggattaaattggttggtctctaggctactgctttaagtaatgaaggcagggcaaccagtggggcagatagccctgtgagggacagtgcgctcaagtgagacattagaaacccagacagtgcgggtgcgagaggcaaaagtggagaggccacagtggcatcggtgacaaaggtgggatttcaaagggatggaagggacctggagttggattctggctacctgatggcccaagatctttgatctttctctgtgtggtatgtgtatgcttaggggacagtgctgttttcctgggctcacacttgggtggggcctgagcctgaactggaagctgcctccttagggacctggcccctgcctgccttaggacaaagattacagttgtggcgtggagaagtgttgggggcctatagggttgggccaaatgccccaagttccctaaagagagattagcctgaccctaaggaatcctgaccctgggcagagccagtggttgaagggtagtggcttagaccagggtcctttggatgtctccagtgcaggcgatggagtgtatgctcagtagacacactctcccttgagagccctgccggccactggatgtggtctggttgagtacctaggcctggtggggaggcttagccactgttctgttagagttgatgctgtccccattgccaggtcaggctgacctttccaagagtgcaccgtgtgcctcgttggggaccctgcacacagcagtgaagtaggctggccaggtgagtagtgtggccagccagtggccagtgcactgaggtcaggggccatgagcgccaggctccatccaagtgaggagatgatgggagggcgtggagatccccgtaggcaggatggagatggtcccagaggagcgactggagggttttggcctcttgtgttgtgatgattcccagggagaaagcagggctcttgtatggattgaggtatggccagacgtgggtctggctctggactctttcttgtccctaatcaatgccctaaaggagatgttggctccctcctttcctcactctgggccagcatctgactcttgctagggaaggagaggtagtgaatgacccttgtgaccccagtttccacgtgcagcatgtttctgctttgcccatgagaagttggcatggttgaggagtatggctcagtgatgtagccagccaagggtctgggggacaggacattctgactctgcagaccaggctgcctgtggctctgtaggtgggcagctggccttagggcaagccctgatgactttgtctgacatggtttgaagtacctcctttgtaccagtgattggcaagtacagagatgctgaggtctgaagtgtttcagggagaaggtggccgaggcaggttcacagatgatctcacagggctccctgtgccccccatgggatactgtcggtctctggtccacttgtactgaatgatccaacacttaatgaactcagtgaacgcatccatcacttaagtccagagcaggctcaacatttcttaaggaaggaggatgtggctagaggcctcgggacagggagggcacgtttctccgacttcttgctctgggagggttttcttttgcaagggagtctaagaaagctgcttcaagggtggaggttggggtggggtgccctcctaagcttctccctgagggggatctaggagccccagacagtgggagagcctgttctcccatgtgttaaatcagaggcttacacacttgctgagctcagacccctgtggaggggattggggactggaacagtcacagcccctgagccactggagtgcttcatgggtcccaggtagagcatgagaaagggtcacctttggccaccatttcgcccctcccctctgtggcgactgggctctttcagctctctgccagcttcaggccccctgccttgacttcctgtcttggccaatttcacttcctaagtagctgcctctgaaattccttccttagaaattagtggggtgggagaacccaagaccgcaaggcaggctggcaaaactgttgcaccgagcacacaggcccaacactcccaggacagacattcaggggatcttcatggatccctgcctctgacactcaggtgtctagagctcctttttgagagagccatttgcagctcaatcaaaacccatgagtgtggaacaaagagctggtctttggggagtagatgctatggagatgagaggccaccctacccccatccctagagccagccgcagggcccaaaatgctccttgggcagatgtcctggggccttctctggggttgggagcagtagagctgtctgttctctgtagctctccagccttaggagctttggggtgtccttccaggagcaccctgacattttcacagggggtatgcttgcataggccccctttggagttccctgtggagcacggtgggattctgtgggaatgacctgtgtcctcagcaggattaggaatctctccaccagccggccgggatacagggaagcaccatctttctgtcccagtcccctggacttctagaacagaatggaagggcaagggctagagggaagagttggttctagaagtcaacctgacgggatgctgctctaggaggctgcttagttgtcttggcctcccgggagcccttgggaccttgcagcaggtgttctcggagaatagaggatgtattaggtaaccagggtccccagacccttggccagacctctgggagtcccatacctccccccccccccaaatggctgtggtgttggagtactcctaagtacatcccaagttccccaccctccacccccatagaaagccttggccacccacagccctccgagaggtccaggctttgggggcctgtgaggaaagggggggtgcgaccgcaggtggaaccggctggctggcgggagggctggctggcgggcgggcggaagaggctgcttgctccctgcctgccgggggtgggagctctgtttttctggatccctcagtctgttcttaccgctgctgacgctgccacggatggggagagagggagggagcctgtgccagttggcccgcccagccgaacctgggcctgtgcccggcccccgcccgcccccgcccgccgcgtctggaggtcacattcagtcctgacgcggctcgttgggtcaggcagcaagaagagccgcgcggagccctgggtcccacagcccagccgtttagggacacggctgcctggccctgtcttgcccggggcttttggatttcttgtggcttggtgggtctgggggctccgggacagcaccctcaccaagtgtcctctctgagacactggtgcctggaagatctgcggacgccgcgtgcgcactggtgacgcctggcacagagaaacccagcacacagaactgacaacttcccgctgctgccgtagccctcgctcccttcccaagcaggaagggcactgctctgttctttggggcagctggtagctgcagccggaggagtcctggggccatccccagtgcctgcttttgccctctcggctcctgaggatgtgaacagaggtagaaccgggggataccagcaagaagccctaaggagccttgcggccacagcctcctaatcaccgctccgctccctggagcatccttccagccggatgtttccggaaaacttggccgagggggagacgcagatgagaggatgtgagtggtccccagctggcggggcaagagggtggggttggctggtgacggggacttctatggggctacaggaaatttcagctgcacatgtggtggtggtggggtcttggaattttggacccgtggcctggcgctccttcttgcctttctagggtgcagccaagatcccctggaaggaggctgtacttagtcttagctccaagcgtgcctggggcattctcagcggggcttccccggggtggacagagcagctgggctgtctctacgacacgggatatgaagtgctcctgtgcacagcaccctaatgtaaggttcctagaacaagagtagaggaagctcctgtctccccagggctgtgtggcacactctgggaagggcctccccaacagctctgcccagtgctcttccctgaccacacgtgttcgggaacagctgagcgtcatcccccccaccctgacagtttctagcttttataggctgagttagttgggagacccagctgttctgactccctattgacctaactgaatttggaaatgtctgttccccggggtcgggccaccctcccctcccaagtcttcattgcaccccacccccaacagctccaaatggagacctgccctggggttccgggcctgcgatccctcggcctgacgtgtttgttgggccctcttggacggcactcgggtaatataaataaacgcagccccagccgccaggttctggaagtggcagctgctgctggcgcgggtggagggaaaggtcaggggctgagttacacttgatcctgagccctggccctccctgcctcctgtccttgaggagccctgagaagctgctctggagccacgtggctcttgtggtcactgtaggccagcaggtggcctggctatcccgcacctcccccaaaccatggcgcgtccccctcccccccaatgctgctactatgggaagctgaggcttcagacccactcctgagctgggtgaggtgggtgagaaaccttcaagaattccagtcttgaccagggtgtgggggaggggcaagactgactcaaagccatgtagacctagggggtcacttgctggtgtgttgggggttttattgtttcctttgtttgtagtgagccaccaactggggtttgaatgagggggtggtgagaagggggtgggccccctcccctgccctccccgccccctgcaattcgtagttacagcctcttgttctgctttgacttgtgttgaagaacatgatttgaagcctggtggtaggaaatgggacttagccttgtcacaagtggctttgaagctccgccgaagcgccggcctcctaacctccatccccaggggcaggtttctggcactgccatgggaaaatggccagctttgccttcaagggagctggggctcattgaaggttgctgagggtgcacagccttctagtatagcccaaggtttgtagcctcagagcttgtgagccatgaggtctgtggccttggggaggggttgaggggggcctccgcagatctgaagattgtcccaccatgtggtctcaagctgtgacttgagacagatccacccgtgactgctaagtgccaggtgggccctgagtctggtgtggctcttgaggtgtgggggggccccaagctcaccctgctcccctccccagctcggccttgctctgacctgagctcttccagggctcgttccccttcacctatggtgagaccggaaagcgggcttgttctcctgaggcctcactgcagctgtgcagtgtcagagctgggtcaccacagctcccgcccaactggggagggaaggatggggggaggctgtcttctgccccctagaatcttaactgtggcctcgcttggggccatgcctgttactgtttgtttcctggtccctccctggctgtgcccccttggctttggacggtagtgaaccctcatctgccctccacctgtaggcctcctggaacatgggaggaactggtcagccattgcccgtatggtgggctccaagaccgtgtcccagtgtaagaacttctacttcaactacaagaagaggcagaacctggacgaaatccttcagcagcacaagctaaagatggtaagtctggccagaactcggtggccacgtccactgggaactggggccagccaggcctcccacagcctcgctcatgtggcccctggctgcctggcatctgcatggggagggatgggtgggctgggccctgactcagccaggaatcggacctggaggtcctaagtgagcagcttcgcttctgcttggctgcccttttgaacagtcgggctacagggacagggaatgagggtcccagaagacagaggctggaggaagacttggggcccacactgacagctgtatctctaagcagggccttttttacatccatggccaggagggccactggagccactgcactgccttcccatgatcctccccaaccccatcttaacgtcatcagcctgttagggctggggaaactgaggaccagggaagctcttcagccacctaagtgggtgtatgaactcagagccgagtagctctaccacctctccaatctcccgccgtggtctgagtgaggcttgtgaaggacaccttgaggcccatcgttccctggctttaaagttgtgtgggttcctgtgcagtgaaagatgtattgctctttcctgagcctcgaggcccagtgcagggtacacagcagcacagggtgcggtagagcatggtccagcagccagagacacagcattgctccattagggctcctctcaagacccatgtggaatccagggacacccttgttggcccaccctcctgccccagctatttcttacggctcgtgtcccccgaacatatgactgcccaactctccatgtctccagggaactgctccctctgctctcaatgacccccggtgggacagtggacccaaggacatagtcatctaaaaggggccaggtctgagcttgtggtctgagcaccatgtgacctgaccagcttctccctactgagccacttctttagctagaaagtaggtggaggggacagtgacacggacaggaaggaggtgcccgtgaatgggaggccctctgtggggcttcctgcctgcttgctctttgtgatacccctgtcactgatgtcatagctacccatcccatgtcctctaggtacctgaagcccttgcgatcactatgcagcaattaccaaggggctgtctgctgataggtgtaggggtgtgtgtgtgtgtgtgtttgtctaggctgtgccacttacaggctgtgtggctttttagctaagagtcttatctgctctgtgcctcagtttctctgcctgtgaaatgggaaggataacagctcctcccaagtgacagggcagtacttgaaaaggggacactaggcaattcgccagctccccaccagctaaagccagatggcagagggctcagggtctttgtggtgtggtatgtctatcccaggtgatagatggatgcaagcctgcgtgcatggagtccctccaaaggacatagggctctgcccggtgggagtgtgctctggccctgtagcttgtgctcagagcgcacagcctggcctctgggcctcagttcccacctgcttcaggagtgtatgaggagcaggtaccttccactgaggaaagtccagtgtctggcccaggtcacagagtaggacagagtttgtgtatagtgggcaaaggcgtggttggagtgtctggaggagcttactacttagtgggatgtgggaatcatggtgagctattgagctgaggtgactctggtctgaatgggatggaggcaggctgcccaggaaaggggacccctgccccgttcttagctttgtcattcaggtggctgccctggcggaggcctgtagaggaggtgggctgattctctccccaggcaacctcaagagctggctggctggtcctgaggatcatgataagagcagtgagcagaggcggaggcccctgaagtacagagcgagtaccgtgttgtatgagtgtatgagctggcctgtggcagcccctgacctgggctgtctgttctcacccactcggcatcaggctgccactgtaaagagggtaggccaagctgcactaaggatgcttgagcccggaggatcaggagttcagggccagcctaggctacaggaccgtgtctcaaaaagaaaatgacaagaactaagaggttcacttctgttctctgagtcctgaagcagtggctagggcctttggctgctggcccggccccgtctgaaagcaggaaggcatgccaccctcagccacccagagaacaggggaggcaggaggtcagtgggtgtccctgcctctcatcccaggcctggcctgcacatggctgctggagactcatcagaaaccgggagcttgggcggagcctgcatgtcgcaggttatgtaacatttggcagccttgtcctctctgaggtctccctccccctccgtgtggccaaaggctgcccttctgtctgtgtcctggccctcagggctcggcctccaggttgctcagtgtgtcatctgggcgctggccctgccggccttgcttccttctgctgtcttctctctgtggctgctgggagacgctccaggcagggatgtatttgaactctggcaggcgggcctccttgactctgcgctttgtgtctctgagtcgtcggtgtcatcctctctggtgttggctcatttatggaatgacgtggttatggagtgtgtggtgactctactccagctgtgggagggaggcagttggagcaggcagaggtcccagttgacgaggaataagtctcgtcaagatgctgtaactcccgtaacttccagcttgtggccccagaggtgcggagacagagatgcagagagagtgagggtttttgcagagcattggttaatcccccagggaaatcagagagggcctctggggagatgacgttgaaggaagtgagtgttcgctctctgggggaagggtgttcaggcagggaacagcctgtgtaaagtccctggggctggcgtggggcctggagaagcagacttagactaggcagagtggcaggactagtgatctggagctgatgtcaagtgttaggggctgcctggagtggtgacggctgtgtggcaggcagggtagctgtgtgtacgtgtgacttgacgccttgcagattgctggtgtgcagtaggtgcttaggaaatgccatctgtgatgtgagttcatatctccaaaacagcgcttacacacgcttaccagccctttgtcactggggctatacagggccgggtgtcccataggctctagaaacacagggtgtgctctgtcgtctgtccatgactctgccaggctgatgggctcccgtttcctgtgagtgtccttgcaacctgctgcctagttcctgttgctaaagatagacgaaggaaggggatccccagccccatgccacagcatcctcgcacccgcagactggagcctgggcctcttgggaggtgccaagaccagaccctgtgtgggcgggggtggcaagtcaaatgtccacgaggtctgtgtatacttagaacaagtctgtggcctagtattggcaatagagacagtgatggactgacaggcatacatctgccttttgttctgtgtcccaggatcctgggacaatggacacagcaagcctcagagcatggtcctgctatgttcccaggacagaatgtcaccagtcaggtgtagcagagctatggtctgtcaccagcttctgatcttggtggtttttttctaacctatgacccccgctgccatcttcccctgaaagagctggtcagttgcagcatgtctccacccaccacaccccttccctcctggcctgtgctccgctcggacagccctgtggatgttgccagaccagcacggagggcatcagctgagatatgagggcgcctggaccacattctgtccctcatactagatcaggcttaccccaggctacatcgtttcaagactagtgcatgtcctgactgctgctttgaatcccaagcttagggaagcctcggctgctctgggcttcgacccagctcagtggaggatcacggaagtccagccaggggagggttttgaatgcttctgtgctgggagggtgatgctaggccctgagtgtggggagtagaggtggtttgagggaaaagcaagacgacagtatggctcatccacaccctagagcctttgtaaataggcgtctctcagccagagccttgcccgggtgagagaggcttaccccatgctagatcatttttccctctgcacttagacaaggactccagtgtcgattcctatagaatcctgatcacccacccagctgacttggcctgtgcccttttttttttccccatttgatcccactgtggtccctggccagtcccctgagtccaaactttagggtgtgtgttgctggctttggagggtagtggccatgttatatatccctgagtctgtatccacagcccctccacttgtgcctaaagtgtgcactgtgacactgtggcctggcccagcctgcacccagggtcccactgggacacaccgtgctatgaagcgtctatggtaaaaatagctctggcctgcatggccactgccacgggctgagtgggaaggctacctacccacacagccgtgcagccaaactcactgctctcgcagccgggaccaggcctcagacatagggcgtccccagccgtgaccgctactgtcctgtcccaggagaaggagaggaacgctcggaggaagaagaagaagaccccagctgcggcgagcgaggagacagccttcccacctgccgctgaggacgaagagatggaagcatcaggcgcaagtgccaatgaggaagagctggcggaggaggcagaaggtgaggtcactgttgtcctgggaggtggggacggaggggagggggagtgaacgcgcacgcacaggcacacgcacactgtcctatgtctccatcttctaggcatccctgctttcctgggccaggcctagggctgagcacagaggagccctgactagaccccaggcttctggccccagatccccatagttcgttcacctgctttctccataggcctggcataagtcgtctcagcatcctcggctgggccctaggctcttggttgaggctcccagccaccctcatgagcatggacatagacagcatggaggggaagtggtggagacagagctgcccacagaagaggggagtgactgtgagccccaaatcctggggagggggatggttacacatctgcttaggagcagagacggggccagccgaggcctctcaccacccgagaattcttggggcagctaacctctcccacccaagagcaatgggctagaaaggctgaggtccaggctagggaccacttgacctcagacttccttgtgtggtaacagtcatggcagccatatatggccttgtctctgtcaccacaggccgaggaggtggctgaggagtgactgaggcatggtggagtcattccaggtccctaagacctagtttggcagcttggtcatagccctctgctctgtgtctctttggcgtccaggggaaggggcctagtgatcttcctgttacttgatgtctgggtctgtaaagtgcctactatgtccaggctctgtgaccatgcctggggcacatgggtgcctggtggaatgcctcagtgcagagctgggcctccagccattccttccctgcccaaatgtagtgcttaagggtccagtcacagttgtcacagtcccttcatgtctctgagggcttctggtatagacataactaactgacagcaagtcgtagacaccaacactcacgatgggggctggcctgcttgtccacaggacttcagtggctttggcctcctgtgtcctgtcgttgggctgctaaaaggaagaccagaggccatggcccacttggtggcccaggctatgtgatttcctcacctgtcattgtgcttcttaagtaccctggtcttgaggtctctgagggtcacgccctgtgtgcttggggcctgctccctgctgctgttaccgatatctgttccgggagagctgtcaagctctgggctacaagggtactgagaagctggggaggctggggactgactgataaggctggaaggcacattggttagggcctcattggtttgtagccctggcactcacacacacctctgttgaccctggacataccttgaccttgcactggggcggaggggtgggtggccagggcctcccttgggagctgagcctagtgggtctcatggaagctgtcttgggtcccctgccctctgcgagtcacaccctctcccctttgtacagaatttgctgtaccaccccagctctgactcctctctaactttcttccttccagcctcacaggcctctgggaatgaggttcccagagttggggagtgcagtggcccaggtaagaatgtagcttttggctgagttggggggcatagtggagtatccaagaccttacatccccatcccttgtccttgggtgctgcttctgcctctgcttttttcctcctacaaagtgtctattccccgatgcaactgtgggcagcatgccctccctacctgcctttcctctctttgggacccttccctgtcccctgtcctcagccttgtctccaggtgtctagtttgcagaaaatggaggaacacacacacacacacacacacacacacacacacagcaccttaaacccatgggagatggagcagcagacatactccttcaaggaggacttcgatgcagtggccctgtatcatgctgggttgtcagccatattgtaatgctttcatggtccccgggcctaaacatggctctcctgctcagcatccatggaggtttgcttcccccttctgtggatggggaaactgaagcttgagagaagccctgaacttcccattggcagtaccaaaagttgggcactgagctgagtggcgttcagaccgtatctacagacctccgatgaaggcctgtcttgaggttgtccttggattggccttgtaggggcactggctacctaaggattctaggggttgggtttggtcagtctgtgggcagcgggaaagagaagccaaagttgcaagctataagggctagtgagggacaaggctcaccgggagggtcatagcctggggttgttctgctattccttgagagggctgtcacatcctatgtagtagctgatcctctcttttcctcttatcctgcatgtagctgctgtcaacaacagctctgatactgagagtgtcccatccccgcgttcagaagccacgaaggacactgggcctaaacccactggcactgaagcattgcccgctgccacccagccacctgttcctcctccagaagaaccggcagtagcccctgctgagccctccccagtccctgatgccagtggcccaccatccccagagccttccccatcacctgccgcacccccggctactgtggacaaggatgaacaagaagccccggctgctccagctccccagacagaggatgccaaggagcagaagtctgaggccgaggagatcgatgtgggaaagccagaggagcccgaggcctctgaggagcccccggagagtgtaaagagtgaccacaaggaggagaccgaggaagagcctgaagacaaagccaagggcacagaggccattgaaactgtgtctgaggcaccacttaaggtggaggaggctggtagcaaggcagctgtgaccaagggttccagctcaggtgccacccaggacagtgactccagtgccacctgcagtgccgatgaggtggacgaacccgaaggaggtgacaagggcaggtgagaggcatccggcgagctttggctcttgtgtattctgcaaacacggggagcaccctccatctgccacaacacaggtggccctgcctaccatggactctgtggctggtttgtaggggtcaacatgagactgagaccagaaatcagggtgtcttagtctctgttctattgctgtgaatagataacatgaccaaggcagttcttccagaagaaaacatttaatccttggctggcgtacagttccaggagaagtggttgagagcttagctaatcctcttccacaggtgaagagagacacagtggggaagggagggaggaggagagctttgtacactgatcctgagcctgacttgggcttttgaaaccttaaagcctgctcccagtgacacattacctccaacaagaccacaccttctaatcctttcaaatagtgtcactccttggtgactgagcattcaaatatgtacagggacacccttctacccatttgaggcaacctggagctaagatctggaagggcttcgaaggtagccatagaaggctccagggagaaataaatgctggtgtcctccagctgtgacacagaccaggtggtgtgatgtagcagcgtagttggaggtagaaggtccaaatccaggtgtcctggagtcacccatactccagcttgaaacatctttcactgatgatggatgcctgtaatccttggcttatggatatagcactctgatcttagcctccatagacattaggttcccctgtacctctctgtttaaattcctgcttccttgaaggttgccagtctcccatgacgacatcagcatagcttcctgacaaagtctcacacaccggggcccagacttagttcttggacgcagggatacagttcttcccttctgtggtggcaaaggccatggctagtagtgaacctggtgtgtgcagtggggaccacgtcatgggaatacaaaaggccatgtattcccaggatgttagacatgaagactgctgccttcaaagggccaggccatggctgagggggtcccagtgagacagtaaagatgccagctatggggcagtgattgagataatgtcacccaggcccagacactggaggcccctggcgtgcggtcaccccagcttatctctgaggtggtagcacatctgtgaaccattctgaatggcacattccctgccctagggacacactgtgttttaggtgagaccatctgggcactgaagaccaggtctggaaacctctccccatcacatctggacagccccacccacctctgggcagccgcggatgctttgtgatgaggcagtgtgctatgtttattttgactgcaaacagcagagtctgttttctcttccctcaagtctctgaaaaattccagcagagcaggggaggagaccatgaccttcagaccggcccacacagggcccttcctgctccccctggctcccctctcccctcaggcctggtggatttgaaatagatgctttgtagacctttctatattccccgaggactccactggtagggctcccatggagcaggtggacaacagatggccctggataagcagaagatggccagcgggcttctgagagcccccatgtccccagcttcttgcctgataggcataacaggggacatagggctcacagcagcttcagtgccaccagggtccacaaagccacaggtgtctctagcttggctctttggagtctggatggtagaatcatagagccaggcgtggggtgccaccctgagtaccagcccactcctcaaacttctgtagactctggtcaggctgaggcctctcagttccttctcctgtagcactagccagtagtttccctccctccctggtgcttgctggctgtccaccttcgaggcttgctatctagcttctaggctgggactcaggatactgtccctgccctggagcacacctgagctctcagtgagctgtgagacttcctgggggaaagctgaccaccttccacagccacaccaccaccacaggggcccagggagagtaaagtgaagtacaccagcaggccccagcagcctgagctgctttctgtaaaccctgcgtgttcacagccagccctacaggcctctctaggagagctctgctgctcactgctgctgtgcctgagccagttcggcttggagttggcgaggagacttgcagccttacctcactttcagagtagggccatggtgctttctagtagatctggatcttggtaagcccccaccccacccccaacccctagcccccatccccccacccccaacccccaagttcagtctccatattgcaaggggtgttttgttagaaccatgacccgggggccaggtacacagtgtttgatgcagcctgtgctgggctgagatggttagatgcaggaaccagcagggccctgattccctgctgctctggcgctggtgagaagaaaggcatatcgctcatgagccatgtggatggtatgtgtgactcgaagcaggcaagccttagggatgcttattgctcttagtgtagagaggaagcctgaacacagggaggagccagggaggacaaaggccctggggcctctgagcttaggcctctgagtttacggttggtgcttctcaaaggactggagctgggaggccagtgaccagtggggtttttgtcttgggtcctgtgaaggccagagatcaacactttttttttttgttactgtctctaattgcatgcctgagtttgagtatgtgaacatgagtgctggtgtctgtagaggaacaaggttcaggtgggttgtcatccacctggcatggcttctgttctctgtaagagcagtgcacccctgagccacctctctgcctcctttatgtatgcatgtcacatttttgtgccgtgtccacagaggcctgaggaaggaggccagaagagggcatccggtcttctggtgttgagccaccttatgggttctggggaccaaacctgggtctctgctctttaccacagagccatctctctagctctagggtactgttctagctttaagcctgcctggagataatggagaaaccgagggacatggtccttgtggagaaggtcttagttcccaggcgtgtaaccatcacgtatgagaaatgcgatttgaatctcagcagaaacgtatttgcgtatacacgaaagtccacttctctattgctacacagatggggtgacgatgctccccagatttactgcagcagtgcgccccctccacctcagcacaccttgcccttggtggctctagagagctgtaactcacttgcgcagtcttgtgacgtcgggtgtcttcagtgtctcatagtgtcattccagaccatgccatcacccaaggggagacccccacagccttcccagctgtgtgtatccactgatgggaatggttcgatgtcctgtgaagggaacagggcgtgtggtccctgtgtctggcctcagggtcagggccccgtgacttggatggcagccccctcaccaacttgtgtgttctttcagcatctgtctatgggtatctgcatgactcaagtagttggctgagaacactcacaagctggtttctctgtgttcttcatttcttctgagaatggttcagctcactgtagggttagtggggaagccttgttttattttagatgtttcctaagtgggattcactatgtagcccagattggccttgaacttgaggaatcttcctgctcagactctccagcggggtggaatgacaggtgccatgccaccccacccaaccagggagtgattttctgaggagttttttcaaagcctgtgtcgtattttatttcaatttaagtttatcaaagttagtcataaaaatggctaggggcagccaggcacagcagcacgcacctttaatcccagcacttggcagatctctgaggccagcctggtctacaaagtgagttccagaacagccagggctacacagagtggaaaaaaaaaaaagaaacgaaaagaaagaaagaaggaaggaagagaaatgactaaggcggggcagagctagtggaacacatgaggttgggtgaggatggcagcaggaacctctgccattggggtgggacaggtgggacagaagggatggaggactcaggatggcctgttcttcctgtcccccccccccaccaccaccaccccattgcctcaggcagctttagcaggcttcatcctgtctgtctgctctccctgcctggctgagcttgtggcagatgcagggcagcaggctgctacccgcagggcttattgcatgcatactttggctacagcagagtctgtgcccctccatctgctgaaggaggcacgcacgctcttctgctgtgtcccccgtggtcctagctgtcaggaatcctcaccccaaaggctgaaatgaagttccagcttacatggcttcacgtaccttgaaccaggatggtctcagtccccacgggtacataggtcctagtgttttcaaggaccttcccgagtgtttgcccctatccaaattcaagggctgtacccatatctcatcccccatcactgaggtcatgaaagttgcccaccatccaggacaggactgagcccagagacatatttggaccgaatacacacgggctccaattagtagagtcatcctcgccatcccagggcccagcctgctcttgctctgggtttgagagaaaaataatctccaaggaatctctctgtccctccactctgatccggttgagtttgtggcctttcggccactccccgagggcctgcatggcccaggcgcccagctaggtcttttcagctgctgcctttgccctgaggccatcttggagcagtgttttgtgtgggccagagtagtgccgctacccagcagtgtgtgttggctggggcacctggactctgctaagggcctctctggcgggccccaccatccaggacttgaaggagaagccatggaggcagggctgccccagccccctctcccaggaaggccctccaagagcctgtggctgatgctccagcctgacctgacacttgtccctccccaggctgctgtcaccaaggcccagcctcctcaccccggctggagatccccgggccagtacctcgccccagaagccgctggacctgaagcagctgaagcagcgagcagccgccatcccccctatcgtgagtgagccctgaatccgagcagcccaccttgaacttctattctcctctgtgctcagcattgctggttggagctttgcctgtggagggaggctcttccccaggctagcggctcccagagatggagatgtgtacacaggactggataggcagtcctgggaggagttgggagatcgggaaggctgggctgagcagctgctctccagaggttcccccatgcttcagaccaggcagctgtggccagcaagcccccagacccaaggacacctcagccaactaatgtccaggtcctttcaggtctgtctttggggcctttgggagctcgccattgtctaaagacacttggctggttttagtcccctcagccatttcatttgaagatttaggttttgcctttccattgaaggcagcgaacagttcatgggggtccaaactggcctgtctgtcaggcttaagtgttggacatgtgtctggcttcacttctagctccccaaagcccacatagctgctacttcttactcctgatgtggggtgtgctgggtggcataggggatcctagcacctgcctggatctgggtgtaggaaacgggcccttccttggcaatgatgaccccctccctatgtctgatgttaaggctctgcctccacatgggggctttaaatggggtgtggctgcctttttatacttggcttttgtacgggccacacggccactccccaccctgtcaacctctgacatggggccaggatgttcatgcccgcccccatgccccccagcaggtcaccaaggtccatgagcccccccgggaggacacagtacccccaaagccagttccccctgtgcctccacccacgcagcacctacagccagagggtgacgtgtctcagcagtcgggaggaagtccacgtggcaagtcccgcagcccagtgcctcctgccgagaaagagggtgagtgttgggcacagggatgcagtgggagtgagaggcagccctcttctctgttggggttccttggcaatatgggccaggctgggaggatacattgttacggcagcagatgacagggctcaaccacagctgcagaagcgcctccagctggggggcttcttgagaaaccagaggcaatctagtgttggggtgtggtatgagtgtgtgtgtgtgtgtgtgtgtgtgtatgcgcgcgcgcgcgtgcaaacatacacgtagccagcttctcctgtgtgaatcaggtcccatgtgatctttgggttccctgagggtgcagtgcagtccactgtcttagaacaacagcaggactgacctgagctgcccgggctagcctttccctggctaaagcatggcctgcccactgtcgacaccccttcatcggcagcccagagcctcctgtgcaggtagtgggcagcacctgccagggccccgtggtatttgcacatcagtgcttctgagcgctagggttgtcagagagagataaagcactcacaactccagttacatcttactcttaacttagtgggaaacaagtggggcggggcgggtgtagggcaggcacaagtgggctgtgtgtccgacaaggatctggtgaggagaggaggtgatggggaaaggcccttcacggactgggagtgggggaggaggtcaaagagggaaatggggaggaaattgtgtagctaaggaggatagtagctttgagtgacagtttgctttgggaggggcatgtcatcagattagcgtcttgggggaaaaaaaatcagtgtctgattcttgttgagaaagggcagaagggagtagggcaggggtgggaggcgggctgaggtgctcctcccaacagctctagggcagcctgaacttgacaggtggccttggaagtgggaggaaggggaggcttgagtttgttcctgaggccaagccagtgggacatagggacatagcgatgacccctggagcatgagggcaggggtgtcttgttggagctgggtttggtgcatactacagtaagggtgggctttaaggggccaggtatatagaacacagtgtgctgtgagaagccacccggactcaagatgacagcctgggatgacagttagggaaggggaaaggcgctggtctggctctggccaggcagctgtggctgagcagggctggagccacccagggccagccaggtcttgctgggttgggccctaggccccagtccctgggaaaagagccagcagtcagtggtccctgaggctggttctgggcccatccttgtggccagtgctacgttgtttcctagactcctccctggggaacattgcacctggcggcaggctctgtctctcacgtggtctggccacagttctgctccccaggggacacatgaacccagcatgcaggaagccagccttctctgtcctggctccaacagggagcttccaggccaggcaggtcccttgggatccccaggcccggctggaggaacaggttgtctgtcctggctctcagccacctgcctgcattggctgagtctgaccccatttccttccagcctgagacttcctctctgtccctagttctccagagccaagctggatggggcagccaaggtatacactgggccaccgcaccaggtgtttgaacttcctggttcagagcaagccctgtaggttgagaacgtgaataccactcaggttactttggtgggtcaccacctctccggggcatgagtttagggggagtttggtctcccgtaaaggagagatgtggagtgtaccacttgggcctctgctggggctccagctttcctggaggacagcctaggactgtatggaggtgatccgggaaacccttagctgtcagtttctgttccaaggtcagggccagtatcattcagggttgtgattccccagccaaggcttgcagctcagaacagatggcagctaaagccagagcttgtgaagcctcagtgagtgctggcctgtctctgggtgttcaacacctgaaagtcacaggggacctgagccttgtggcacagccatgggcacaggccatgggctggagccagctgcctgcgttctcaggtctcccctgcactcagcagctggggcctcagtcttcccatctggagggtgaaggaacagactggctgtgacatccgaaacagtgctaccttttgctgttgtttgtggccacatgggctccaatccagacatggccatatttggcaggtgaccgaagagacctgatcaaacgggtctggtcactgtcctcagtgtaccttacaggctcatcaaggcccggctggagctcagcctagtgaccagtatagtagatggttagcgcacagactgcctctgccccatgctcatctagaatgactgctataaccacatccattggcagaacgtgcagccagggagggcagcaagcctgacccagcactcttggtcctatacatccagttggtggcattctgcggggaaccgtgaagcaaagatcagccctctgacacatggcccctgtggtgcctgtccctgtggtctggccatgagccagtccactaccaagcaggtagcatgggaacgtagcagcacacctccactgacctgtcccagcacccctcttgtcagggtcctgtcacagcttgccagtggtgtttgagggtatggagatggcagagccctccctgactgcccaccttaactctttcagcagagaaacccgcattctttccggctttcccaactgagggcccaaagctaccgactgagcccccacgctggtcatcgggcctgcccttccccatccctccacgggaggtgatcaagacttccccacacgccgctgacccctctgccttctcctacacaccccccggtgagtgggcagcgcaccagttaggtctgtgcagtcggtgggcagccaactctttcagtgtcgcagggctgcatggtgccgatcggatgagaccttggctgaaggtgtgacctgctcactcctgtgaagctgggcaccttctgagactcgggaaagcttccgcactacctgcacggccataggcagccttgggaggaacttgagctggaaaggggaggccagcgtgggaggtattttccaccagtgactaagaggatggtcattagagggagcagtgggcagtcttgattgacagatagtgtgagagactgtttggggggaagccacctaggttttctattcttgatggtccttaccaccactaaaagtaatccagccaggggccagtgataaccagcatcagcagtggctggcccaggtagagctgacccatgggacaagtgtactgagggagcttggagaacagggaaaggcatgccaggcagaaggaacagcatagcatgtgcaaagggccagaagcactctcgagtcgggacacttgaggcacccgagcatgctgtcacagcataacatttccacccagcaagcccagggatccccagtcacatgtcactggaatccaggccggaggtgactctcctgaaggcatagggaggggatagcgtgctgactctgggaaaggtccctttggcccctgtgaggagaacaggatctagggagggagtggaaatcggggtgctggcttagaggcttgggtgtggatcgggggtgggggtggtgacggtgcagcttcagagaatccaggactgtggggttcccgtggagtgctcaagccactgaagcagagacatgtggaggagcctccaagagacacttcatatttccttgcaggtcacccgctgcctctgggcctccacgatagtgcccggcccgtcctgccacgtccccccatctctaaccccccacccctcatctcctctgccaagcatcccggcgtacttgagaggcagctgggtgccatctcccaggtgagtacctctggggctgggtctccccatcacagggagcctttttgagccatggggtgtttccagggatggtactgggtgggagccggctgggctcatccctgcgagttgggccagcctacggggctacgtggatctcaggctgtgcattccgctgcctcaggcaggtgactcaacgtctggaggcctcagttcatcctctgttcagtgagagggtggggagctgcagctgctacaggctatcgagtgtcacgtcataagcccttggtcacctctgcatcctacctgccctcagcacacgggatgcgaagcagtcacactgtgtcctttacgtgggcactggccttgggcagttgttggcctgtctcccatcctccagctgagtgggccgacagccccatctctgacctgcatatccttaagtccagagtggggctctccctgtgtctgaatctggttgtgatctgtttccttaccctagcaggggatgtcagtccagcttcgtgtgcctcactcagagcatgccaaggcccccatgggccctctcaccatggggctgccccttgccgtggaccctaagaagctgggtgagttcccacaacctttggttccttacaacttgggctaaggggtgggcagtccctggtgggaggggcagcttgagacctctgtgtatcctctcacccgtccctagcccccttcagtggagtgaagcaggaacagttgtcccctcggggtcaggctgggccacctgaaagtctgggagtgcccactgctcaggagacctctgtgctgagaggtaaggctggcacagtcaccttcactcctagagagcctgaaaagcccacttcacagctgtttcctcatccttgagacaccaagaaggacagttgggtggctttcagacatggggtcctacgagctgggtcttttgtcttctagggacagcactgggttccgccaccagtggaagcatcaccaagggcctccccagtacccgggctgcagacggccccagctacagaggctctatcacccacgtaggtgctgggggcagggtggtacgggcagacatgccaagtggcttgggatgggatgagaggacctcctgggagactagagacaatggctgaatggttgatcactgtgccgtgtggggtcaggcctagggtgataaagagaacaaacgtcctgtgtctctggcagttaggtgtggcagagaccaaccacagatagggatagccaggctcataaccaggctgtcaggagccacaggcgatagagtgtctggactgagaaagttacctgggccaggaagaggaaagtgtgacatgttattatggccggaagaaatagagggagcaggggtggcagctggcttgacatatcaccagtcaggtaggcataagccagtggtgcgtgccagacttagtacccaccgaggcaggaaggatggcgagttccaggcgaacctgaactgtagcctgagagaccttgtttctatgaaacagtatggtagtattctcgatagcatctctgggagtctgcaagtgagaggcagggtgttggcagcagcattggcactcggaagccaggatgagagacattgacaacaatgcggaggggagttacacatgtgtggctgtgctctgtgcatgccttgcggggtgggggagtgggtggggtgtgaggagtcacccacagatccgggtgcctgccactccacccctacagggcacgcccgcagacgtcctctacaagggtaccatcagcaggatcgtcggtgaggacagcccaagtcgccttgaccgggcacgagaggacaccctgcccaagggccatgtcatctatgagggcaagaaaggccacgtcctatcctatgaaggtgaggacagaggacagacaaccacgaggctctggcagttaggtggggtggctatgcctgtctctccctttctttccgttcacaggatgtcttttctcaagacagacatagcaaggccactgagagcaaccaccttgctaggctgaggcttagcaagcaagcacatagcagatagtacttccctgccagctcgcccctgctgggagtgtgttggaaaccctttgttgattaggagtcatgaagaccggactgcaacacacggccccagacagccgttgtggcgtgtctccactttgctgagaggggcccttggagttggcgttgtagcctggacaggttggggtctgggcctaggtttcatgctcagggtcctcctatgagaataccttcctggccctggtgagacaaggcagcccttgttagggctgtagggtctatagaggtctctttagaaccaggcagagctgaagtgatatcagggtgcaggcaggggagtgacttctctcctgcaggcatacaacccagatgaggctggggctggccttggcggtttccccctacataggctgggaaagctgggggcagccttgagtgccgtgacagggaagggctgtggcagagccatgccaccctcttctctggctagaaaacgtagccagtgctacctaaaagttgaggaacccgcccctgggaagcatcccccataaccaggcaccctacaaacactcgctgcttcaggcctggggactgccagcttccctattccttgagccccacagccccctaatccttgaggtcacaagtgaccccgtgtgtccagggaacaagggcaccagctgcctcaggtgccagctgcatgtcctggtgacagccccaaagagctagtagagcactgagtcacagcttgggagcctccagagtcttagattgtaaccttccagcctgtctttgtggagatggggtgtcctatgcgtcttttctgggcccagtgggtctgaggcagttcagagtgtcacccaccgtcagtcccagccccagctgccaccctttctttacaatatttctttgtattctcatacattagccagcatgttccaagtcaccagtgataacaaagccactctgtccctggcacgcagaggcacacctgtaaactggcctcacatggtccttggactcacacatatccacttgtgcacatgcagagctgcaggcgcttgtggaggcttccctgccgactcagactgtgttgacatctttagtgtgcacatacacctatgggtacagacgcatacccacccacttacaaagcccgggtgggcatgccctgctctttctgccaattgagctggtttgagggtcccatctgtgggatggcagggcctccttccagctctgcctattggcgggcctagcaccgtgcctgtagtgccagccccttgcagccgtcccacatcgtgtgctttctccggctcccaggtggtatgtccgtgtcacagtgctctaaggaggatggaaggagcagctcgggcccaccccatgagactgccgcccctaaacgcacctatgacatgatggagggccgtgtaggcaggactgtcacctcagccagcatagagggtaagtgtcccgctgtagccacttaccaggaccgagcgctgcccaggaacctcccaggcacccaggccagaatggaaaaggaggtggcctcttgacaagcttggagggatccagttagtagttggctcaatattaacagatagagaaactgaggcacaacctactgcagaatggggcccagggaagtggggggtgctttcttgctgggtcttgcatcatgatggaaattgttagtggtagaccacagccctcccagacaccatatggtgacaccatgcctgttctccccaggactcatgggccgcgccatccctgagcagcacagcccccacctcaaggagcagcatcacatccgaggctccatcacgcaaggtacctcccttatggtgtgtggttccgcccccgggccaagtaccagctaaggggttggaaacagagggtgagcttccccacccatggtctataggtggagtgaatacttggccccgactccaaagcttcagcaagcacgccttgctagtgattgggagggggtccagattgaatggaactttagctcgtgtctctgtggtaaactgagcagtgtggttttacttagcatcctcacggcatatgaagagacaggcttagaaaagtcagttcgcatgcccaggggcccacaggaaggaaggatttgtgctgacctagaccgagccaggcaaggcagtggacagccagtgctgtgtgcctgacaggcatcccgaggtcctatgtggaggcgcaggaggactacttacggcgggaggccaagctcttgaagcgagaagggacaccaccacccccaccaccacctcgggacctgactgagacctacaagccccggcccctggaccctctgggtcccctgaagctgaagccgactcacgagggtgtggtagcaactgtgaaggaggcgggccgctctatccatgagatcccgagagaggagctgcgccgcacacctgagctacccctggcaccacggcctctgaaggagggttccatcacccaggtacgagagtgcagaggaggggggcatgggcaagcctggggggtgctaatgctgccctcgttgcattgggttataaactgaggcccagagacatcagcagctggccctggtcactgacagtatttgtgaaacccaagtcttatgtccctaacttgtcacttgactgctccccacgtctccacctgcatgtatgtgtcaagcctagagccactgtcctctaacttggtcatagcttgatgggaaagagaaagacaaaacagccagacaaaggcgcctagggagggctatcccctgagccagggacacactcagtgatgggccagaatgattctagagaattcttttgaaaatttaggtgccactcttctttttgggcccagcacttagaaggctaagtcgggaaggttataaatttgaggctaacctaggctacaaagctgtactctagcttaatgccagtcaccacagttataaagtttaataacaacacagacattgagtagcaattgagatctaggacctagctgtgctccgtgtccccggcttggatccccccgccatcctctccatgatgtccaataattcccttctctgtggtgccctctgagacctaacagggaatatgtaactccagcctgggacccgagccacagctggcgtggcagcaagtgcatctggctatggaattccatagcattgcaagatggtgcagtccccactgggtgaggaaggttgtgttgacctgaagttagcctcactctggaacccctgggccggtgggtgaccctggatgtgtagccagactcaagtgagcagggcgtccagcctctggacatcatgtcctgctaaaggtctctgtccatttgcccaagggattagagatgccccatcctgtgcagacatacaggaagagcggcatctggccagccaaatacagacctgcaccctctccccagggcaccccactcaagtacgactctggggcaccctccactggcaccaagaaacacgacgtgcgctccatcatcggcagccccggccggcctttccctgccctgcacccgctggacataatggctgacgcccgggcactggagcgtgcctgctatgaagagagtctgaagagccggtcagggaccagcagtggtgcagggggctccatcacacgtggggctccagtcgtcgtgcctgaactgggcaagccacggcaaagcccactgacttacgaagaccacggggcacccttcaccagtcacctgccacgtggctcccctgtgaccacgagggagcccacgccacgccttcaggaaggtcagtgggtgagactccctcaggctgccagctgtggggaggggacagctcacttcctacaggataccctggccactgcctcttgccacagccagtctgtctcctgccctgcctctacactgcatacagggccccctgaaaaagtgttttttaaataattcaaggctgaggagaaggctcagtagctgcataagcatgaagaccagagttcaaatccccagcacccacataagccaggcacactcatgcacgtgtgtaattcttatgcttcacagtgagacggaaggccaagacaggagagtctcctaaaggtctcgggccataagtgggagttaaatatcccagacatggtggagagtgaaaactgaccttcaaaattgtcttgacttctcactacacaccatggcacatttctccattcatgtgcacacacatacacacagaaaaattaaagtaaaatcgttcgaatgaaacagttatcactccgtaggcttcatctgtccagtagcactgctggtctgaagcccctgcctgtgacgtcacccccgagttctgtttccctctctgattctttttacctccctgacttccactctcattctccgatccttctcagcctttccctgtgctggccccctctttagagggctccacctttggttctgtttctagccaacccctgtataccccacaacaccctaattcagatgtcagggccaccaggggaggctatggccagttccagccacatcctggctaggcttgtgttaggtgtcagatctgtgttttgattcattgtctcagggcgcacttcccaaagcattgagatcatttctctctcaagcctgtgtgcttcctactttgtggttcatctccgacctggagcaaatggctccttggggctcagggttcttgcctgctttgttcttggggtgctccagcccatgataaagtcagactggtggagtgaatgcggaatggtgaccagggagtaaatggatattttcccaggggaccaacagcagaggggcaagaggccctggggtttgtgacagctcagcctggtggccccactgaggctgaggctactgtgacctgtccccacaggcagcctcctatccagcaaggcgtcccaggaccggaagctgacatctacaccccgggagatcgccaagtccccacacagcactgtgcccgagcaccaccctcaccccatctccccctatgagcacttgctccggggcgtgactggtgtggacctgtaccgtggtcacatcccattggcctttgaccccacctccataccccgagggatccctctggaagcaggtgggtgtcctgggcctgtagatttggggcttaatgattctacttccttgggtgggctcttggggtctggagagttggggctaggcttagtatagagatcatcccctggttagcccagggcaggttccaggggtgggcttgggatcctgtctctcagtgggcttcttttcctggaggattcatctgtaccttgcagtaagtgaggggctcaagtgagtgccatgacttgagcctttttaaaggctcctttgttagggtgtcaggagctatattttgacgcattatatctgtgagcacttcccaaagcattgacagcagacaccccacatgatgagggagcaagtcttaagctctgtgtgtgtactggggaggcatgtgggtgcacaaggagaggaagctgaagtggggagtatgaagataagacatgggccacctgaccctccctccctccctccccagcagccgcagcctactacctgccccggcacttggcccccagccccacctacccacacctgtacccaccttacctcatccgcggctaccctgacacggcggccctggagaaccgccagaccatcatcaatgactacatcacctcgcagcagatgcaccacaacgctgcctccgccatggcccagcgtgctgacatgctgaggggtctgtcaccgcgagagtcctcgctggccctcaattatgccgctggcccaagaggtgagttacccaggactgcgcccatcagcagaggcttgcaaaagacgagtgtctttgtgtgcactgtgtaaggtgggaagaggggtcacagttgcccaggtgaactaggtggtgcatgctggctccttgggagaagcaggtgctgcttagatcttttcacgtctagcagctgtgtaggtagcaggcacctcttgctaccatgcatgttgttctgagactttggtatgaggcatcttttgacattcaagagatcagaacacaggctggaccgggtgttgcataccttttctctaagtatgcgggaggttcaaagccagcctcagctacataaagcttgaggtgccagcctgggctatgtgagtccatttttaatacaaatgtgtcgtcgtgttcccccccccccaaaaaaacaaagaaaggaatgagtgtgaagccttttggagcactgacttccagagcctgtgaagagcccaggtcactttgtcacgactgttgagcagctctgtgggtttcagagggtgatggccgtgtttcggttcaaaagatgttggttgagagacactaccggtcagagccttgagaagggagcctggggccaagcctggccctagggaggggtacagcaggtgcaaggtctcaggcctacacccttgggaacaggaggtcagaaccctgcagctaatacccccccgacccctgcaggcattatcgacctgtcccaagtgccacacctgcccgtgctggtgccaccaacgccaggcacccctgccaccgccatcgaccgccttgcctacctccccactgcgcccccacccttcagcagccgccacagtagctcaccgctgtccccaggtgcgcctggcaagtgggtgggtgggttcgtgcctcactcccgatgccctgcaggtaagttctggccccttggctctggctcacactctggccctggggtttctaggaggccccactcacctagctaaaccaactgccacatcttcatcggagcgggaacgggaacgtgagcgggaacgagacaagtccatcctcacgtctaccactacagtggagcatgcacccatctggagacctggtagggcaccccagaccccgccccacccccaggtcctcatgggccacctgggcctgccccctgactcggcggcctgtcaccaggtacggagcagagcagcggggctgggggcagcagccgccccgcctcccacacccaccagcactcgcccatctccccccggacccaggacgccttgcagcagaggcccagtgtgctgcacaacacgagcatgaagggcgtggtcacctccgtggaacccggcacgcccacggtcctgaggtgggccaggttggcaccggggggaacaagcctggggggagggcacacagatgggtttgttgagtgggaggggtgtgtgtgggtggacagatgggtagagagttgaacagatggcagcaggatcagaaggtgggtgagcaagtgagattacaagagagtgggtagatgggtggcatgcaggcaggtggaggtcggcccagaggagagggcacgcaatgagtagacggggagatagaagcaggtagctgggcagatgacagtgggcggatagaggatgctctggatagacaggtatcaggatgaacaaagaaccagggggatgagtggggatggatggatggatggatggatggatggatggacggacggacggacggacggacggacaaatggatagatggacagatggactgatggactgatggatgcatatatgattaagttgattggtggcggatgaaggggtagatagacatatggggcagatgtttggatggatgggtggatggatggatgagttggagcagatagataggtgtaagtggatggatatgtgcctgggtggatgaatgggtgaattggataggtggatatgtggactgatggacaggtaagcagacacacagatgaatgggtatacactgggcagctggatggttgtgtatcagtggtagatggatagataagttgagatgtatagaaaggaagataggggtggatggatggatatggatgcatgtggatggatgagcagatgggtccacggatggctggatggacaggcagatgagtggatagcagagtgggtgaatgaatggatggactacaggtggtggatgatggggtgggtgcatggagtccgttggtagtcattagtgtataaggcccagaagtaacaacttcagagaacagaactgggagcttaatgtgaggccgcagggctggtgctgctcacggcgctggtgccgggatgcctgccttctgcctgaagtcagtctcatgcttcctggctctcatgcaccacactgctgagaggctccgcactcctgccgacttctaggcgtgcctcctactggccctgcttgagcctcctgccctccccgcaccaggcttcttctctctgacccttgggagaggatagtctgcctctgtcactgtcttcccagaagctcgggcacccttgccttaagtgctgtattctgatcatctaggagggtaagaagctttaggtgatagggactgaatagagccgagcacagcataggagggtcagtcaggagggcacttgttctgggagcctcagagagtgagaatctaggcagggactctcagtcagggactctgaaggtgtgaggtaggaagccattggccagcactgcctgactctctccctgtccttgcaggtccacctccacctcttcgcctgtccgcccagctgccacattcccacctgccacccactgcccacttggtggcacccttgaaggggtctaccctaccctcatggagcccgtcctgttacccaaggagacctctcgggtcgcccggcccgagcggccccgtgtggacgctggccatgccttcctcaccaaacccccggcccgggagcccgcctcctcacccagcaagagctccgagccccgatccctagcaccccccagctccagccacacagccatcgcccgcaccccagcaaagaaccttgcaccccaccatgccagtccggacccgccggcgcccacctcggcctcagatctgcaccgagaaaagactcaaagtaaacccttttccatccaggaattggaactccgttctctgggtaagaccaccctgacagcggccacgttcatagacgcaataatcacgcgtcaaattgctcacgaaagggggccgcgagaaggaggttcgctggccaacgactcccctggcgacggtaagacatccggcccgccgcctgcccaccccatctgtggcctaaagatattttcagatctttgcttttaatttttccccctttttcggttggttttggtattttgtttcgagctcgtcatcctggtcagttggcacgctgtggtgactccgcccacacgggcccctcatcgtttgcccatcctgtcgtcatgagttttttttccttttttcctttttctttttcttttttttttttttcctccttttttctttttggatttttcaccttttttcctttaatgaatggatctgtggtttggactccgaccgcgcctcccatctcccgccaccacctgcaccttcgttttggggagtggggatgcaggggctaccagctgactgctgctactgttcctggaggaagtcaaggcagggagcgagggggggagacagggtgggggggaggctgggtgcccacctcctcttcccacaccagcataaagcccaaagggagtgatcagggacagtggggctgggacaaggcagggcctagggacacagttgtctagggacacggtgtcactcagcttgaaccccacaccatcacaccctgaccccatgcacactcaagctcctctccagtttctccaccaccacctcccccagtctctcctcttctacccaagccccacactgcccaagccagactcccacagtcctttgggtgtgtctgtatcctgatacatggaactgtctgtcacttgccattcctcctttctggcccacctaggcttagataatttccttccatcttgaggcccacactgtggaggaatggctcatcccaagcaccccccaaacccaagcccacccaccttctgaccccagctcacctgtttcaggttaccacagtggagctggctacagccccgatggggtggagcccatcagcccggtgagctcccccagcctgacccacgacaaggggctctccaaacctctggaagagctagagaagagccacttggaaggggagctgcggcacaagcagccaggtaacacccgggagagtggcaggtggggagactaaggcacggctccacgctgtccccaggccctgacaagctctgctcgcctccttaggccccatgaagctcagcgcggaggctgcccatctcccacatctgcggccactgcccgagagccagccctcatctagcccactcctccagactgccccaggcatcaaaggtcaccagagggtggtcaccttggctcagcacatcagtgtaagtgtctatttctgggcccccaccgttggggtggataggagagtgacgtcccatagtcagacagatgctagcatgcactggccactacactcagtcctgtggcggctgtcaccataaggtctgcctggggacactcacccaggagaccaagagtcagatcagggttctgccctactctacactgaaagtcctgacctgcctccctcccacaggaggtcattacgcaggactacacgcgccaccacccgcagcagctcagtggcccccttcccgcccctctctactcctttcccggagccagctgccctgtcctggatcttcgccgcccacccagtgacctctacctcccaccccccgaccatggcaccccagcccggggatccccccacagtgaagggggcaaaaggtgaggatatactcatatctgtgtcagatgcttggctgaaggatattggggtagggtgagcttgactgtgttgggctaatgggaacctgaggctcagggatacagaagttcactaagctcccagaaccaacacaaagtctaatcacgaaggtggcacacccaaggctcccatgtgccaactgagtgtcctatatatgccaactcagctaggggtctgatgtcccacgcccatttagcagataggaaaactgaggcatagagaagtgagttaccatcccataccatgcacacatacttaccctggctgggcctgaggctcggggcatgagagaagctggggccctacctaggcttaggagcggagtgaggcatcttgtatgagtttgattttagaagcacgggtatagacagtgaggttctggcatgggtgcctcagtgtggtggcacacactctactcaggtgagatagctctggccaggctgaggcaggaggattgtgaacttcaaggcagtctgggatgtactgcaagaacccgactcaaaaatcaacaaaagcttacaagtctttaggttatctcagaagatcgtagtagcccactggggtctccatacctcagctgcagagtggccatttacagggaaatgtgcagggccccgctgtggacagtggggtctcctcatcatcgggtagaacttcaccctcagctaggacgctatctccatcaggtccccagaacccagcaaaacatcggtcctgggcagcagcgaggatgccattgagcctgtgtccccaccagagggcatgactgagccaggacatgctcggagcactgcgtacccactgctgtatcgagacggggaacagggcgagcccaggtacccatagcacaaatccgcgcttagagatggtggtgtcagttccatgtacacccaaggcctcggccctcccatatggaggccattaatccctcacagctcagcgggctgatagaccttcaggggccttcagttgcagcaccctgtgtctggcatcctggtgcctggcatccctgtgtctgggatctcagcctgagccatgccctgttttatcacttgctggtgatctgggaatgaactaagttgaaccagactgggtgggggtggacatggacttcagggagggtgtgacctgcacctgtccagttccctggggattcttgtgtcagatctagcaataaggcattgctgggggcaattcacagcgtacctgggatgggaaccagctggtccttagcacctcacggtagctcaagtggtgagctccctgttgctaaaggtcacaatgcccagcctgctgaccctggtgtctcctgctccctgcaggatgggctctaagtctccaggcaacaccagccagccgccagccttcttcagtaagctgactgagagcaactccgccatggtgaagtcgaagaagcaggagatcaacaagaaactcaacacccacaaccggaacgagccagaatacagtaaggggaagccagggctagagcaggcaccgggagggagatagtactcttaaaccttaccatggaagagcccaacgttctgccagttggtactaactgacaacagcatatagcactttggtaatgccctgcacacagtaggtgcacagggaaagctgtagagacagccctgtgctgggtgctgaggagcacagcacactactccaggttcatgctgcagacccggtgcctttcaccacggctgatgtgggtggacaaggactcatgtccttagcgcagggtcacatgggccatatgcttacaagaatgcaccggaaagcaacacatgacagctttgcactgtcccctccccagggtggcctggacagacaggcaaggttcttcctttctggagtatagaagccctcacaggtaacagaggcctaaggtagtgaccaaccgcctgagtaaacctggagcatcaggtgcctggttgtgcccagacattcaactcagactgtacgggggacaagcaggggtgcagatctcctaggacctgtgagctcagcccttccccaccttgttaccctgctctagatattggccagcctgggacggaaatcttcaacatgcccgccatcactggagcaggtaaccctcctgtgtgtccgcatggcaaactcccttccccagtgctgacttggggacaaggagccttagcctctccctggtctcagtggacccagaatgacacagatgggcagcctccactgcctagggtcctccctacatgaggagtgcccaaggtttgaggtcagggtccctcaagtgggtgttaggtacaccccggaaacacttggccagttgctggggcttggggctggggcacgtcaccaagtgtggacctgagggattggccttggggtacagagattcagggtgccgcaggcatctttcacactaaagtctctggccattttctaaatcagatgcaggcagtaatgtgagggaaaagtgtcaaactcacgtgcagtttgtggcagaagtctcaggctttcagtatggtgcttggggcttagagcatccgcttcccgtgcttattatcacgttgccccctgggaaagaagcttgtcgtgggaacaaatgggctcggtgactgtgtcacaggggaagctgtggggacttaatccaggccagaggaacaggcaagggtccctacttccttatttgtgtggagccttgggcctagggaataaggtggccagattaacccttggggacatttccagaagaccacaggacctgtaaaggggatggggtaggatcctggcagggacagcctggggcctttgctgagcctcaagcagaaggaaactgaccgagacaggaatgtggttggagatgcgtgtttctagagtgtgctaaatcttgacataggttctagacacctgggtgtatatgcatatagatagggtaatacagtgatttgtgctaaaacctaacttagttgtctctctcacacacacacacagacatcctcaaacatcgccccttaaatgttagttctcaaagacatgtttccaggcctagccagtgacgttcaacaccacaccaaaggtagatgagagaaaagttatggctgtgcccagtgccatcaggtcacaagctcaacaccacggagacaaggcccaggagccgtgctccatcaggaaactcccctctgtcccccttttctgtgttacctcctctctctccctctttattctggatgtagaggagtggtggggtggggcttgtttatttaaggttgaattgtgtgtgtgtgtgtgtgtgtgtgtgtgtgtgcgtgcgtgcgtgcgtgcgtgcgcgtgcattcacccctgttggaagttcagctttttcttggtaacctttgcttagcactgtgggcacatgaccaacatgaccagccctggcccgagcttgcctgaaacccaagccgaggctgccagcagtcacccagtgactgtcccttccatcctcagaagcctggctagtttacaaaccagaggcttgccagccagcatgtttggccatgtggctttcacaaggctcaggcagcctggaggttcacagggcatcagagactggccagtggcatgggctaggaatcctgctgatgacgtcgtcattgtttgtggttttgttggtggtggtgatttgggtttttttggttttttgttttgtttcatttgtttggtttggagggtggttgactcgattgagcttgccactgttttgttcttttttccatctggatttggagcagtttgttgatacttgggattgaagcactcaacccagcaagtgtcccgtcctgtagtgagcaacaacacagccctcttctctgagggcaggtctcctcggcagcccaggctagcatggactgcactgaactccctctgtagactaagctagcctcagaaatagctggggttccaggcctactaatcaggctccaaccctcaggaggctccggaagcatccagtgagaaggggatgcctgcctgccccagcatttaccagaagtcccagagcacaattcggggggggggggaaggagggagggaaagggaggaggagggagggagagagagagagagagagagagagagagagagagagagagagagagagagaaccagagaggctttgcagaggctcagtggagtctgcaaacatcttctaaggccactttgttgatttgaccactctgtccttgtcatggggccgggccagccagggctggagtgacccttcacctgtccagtgctgtcctgtccttgcacgcacataactgcatggctgtgacccccaccccaccccaccccttgtgcccagctctctacctttctctggctcctgtgggggagacatggggcaggggaggcaagcctagttcagggggatcaggcaggctgaggtccctaaccccttgaggaaaaggggacagcaggggggtcctatctttggtcaccttcctcctccacatcccttcctagaatctacccaccagaagaccccagctggacttctgtcccctgtcccagcacctagctccagcttgactcaataccacagccttcttcccttgcccgccccttgggccatccacgtggagtcaaaattttaaaaatagcctcagttgggattggagtatagaataggaatagagctggggaccctctagccaccccagagcccctccctggaacagccatgagctgcagggacagtcaggaaccccatcagcacccaacagaaaggcgggctggagggatgaacgatgctcggcagatgtgtgctcactgtgtctctctctctctccctctctctctctctctctctcctccctcctccctcctcattctatctctcgtaaccctctggctccccggcccccgcccccctgtgtgtctgtctgtctctctcccaggccttatgacctgtagaagccaggcggtgcaagaacacgccagcaccaacatggggctagaggccattattagaaaggcactcatgggtaaatatgatcagtgggaagagcccccgccgctcggcgccaatgcttttaaccctctgaatgccagcgccagtctgcccgctgctgctatgcccataaccactgctgacggacggagtgaccacgcactcacctcgccaggtctgcaggcctgccccctgcccgcccgcccgcccacccggctgtgtccctccttatcccggtgtcgttaatcctctcaccttccccccctcaagcttgggagcctgtgaccttatttttgtgcgtttgacatctagtttgctaatctaaagctggtctgacaccccatgttgcggagggcgcccccccttttacccccagcactgctgcttttcccgtgctcacatcactccccacatcctcccctgctgtgtggacagggatgacagcggccaggcccaccatactgtggccagggcctctgggaagagtctagtgtgggcgtgaccccttgaaggccagacagcacagctccccactcttccaatgtccgtcagcacttgttgtttccaagcagagacacaagcaaagaggtgccctgctgtccccttctagggtcaggccagccccggtctggcgctctcagcagaggccttcagtccggcatagttgagtgctgtcttgggcaatgcctgtcatccagccaagatctgacattcctcagtgaggggtacagtcctgctgggagcacctaagggaatagtcatcaatctctctcatagtgaatgttcatgcctttcttcacaccaagggctggctctggccatctggtagacctcttagcctcctggctcagggtttctcacactaggtttctgtcttgggggccctaggaggcaggtggctccccaaggcagaatcagccccactgcccctcctcagtgctggtgtgggtgtcctactgtcaaccccgtctgacttggccccttcccactttgtcccctgcaggtggaggtgggaaagccaaggtctctggcagacctagcagccgaaaagccaagtcgccagcaccaggcctagcgtccggagaccgacccccttctgtctcctcagtacactcagagggggactgcaatcgccgaacaccactcaccaaccgtgtgtgggaggaccggccctcatctgcaggtgggtatcagctaggagtagagatgtatccaggggttgggggttacctgggctacccaagaaagaaggtccctgatcaccacttagcaaggaggatataggaagaaacctatcagagggtcctgtgtagctggccagaccttccaggcatggctcgtcatacaggggaggctggcagcctttcttgcctgtcaggcactgtaggattttgacaggacagtaaaggcagtagaagacaggacagagggagagcggaaaggttttactggagtccagtcaaacggtggtagggctgtcgagcacagaggcaaagggaggaggccggttttgagaaactccagagttagaggtcctggcccaagagacccaggctctggtttcttatatggaagacgggtcctgaggtgcctacgtgtagcggcttgcagagcctcctgcagcactctcccatctttctcgcagggtccacgccattcccctacaaccctttgattatgaggctacaggcaggtgtcatggcctccccgcccccacctggccttgcggcaggcagcgggcccctagctggtccccaccacgcctgggatgaggagcccaagccactgctgtgttcacagtatgagacactctcggacagcgagtgaccacggattgggggggagcggtgccaggtccccgcacaaggcagaagcagcccagcatggagcagacagctgctgactcccgagactgaggaaggagcccctgagtctgcctgcgcgtccatccgtccgtccgtccactcatctgtccatccagagctggcatcctgcctgtctaaagccttaactaagactcccaccccgggctggccctgcgcagtgaccttacactcaggggatgtttacctggtgctcgagaggggagtggacaggaggggagggacagcgggccaggagggggggggacagcaatcgtgtgtcagtcgcactcgtgcatctggggcagcggggacccaccacaggctgaccaggcacctccatgccaccgcctcgccccttaccgcatttggaaccaaagtctaagctgaactctcgcgtggtcctgcccctccctctgcccccagcccgcttgcgctctggacagacagacgttcccagcttatcctgccctaatgctgtcatcatcgcagtctccaaaggccacccagcccacaagactgggagcccatcagaccaggtgggtgcacaaggggccaggcctggcctggggcacggatgcttgcaggaactggaccgtttcccggcctgttgctgtggcaacgggagggaaggcacgtgtaaatggtgttggcttacagggtatatttttgataccttcaatgagttaattcagacgtctcacacaaggaaggactcgcccgtgtttctgccgctgtgctttggtctctacctactgtttcagaggcacgtgccagccaaggcggtggccccaccatacgcaggacttgggggtcaggggctccggcacacggcactgtgcccttcccccccacccccttccttgggcaaaatggacttgatgcgtattctgtggccgctctctgtgcacggcggcattctgtcatttacacatgttgttccaattagaaagcaaatatactcaagtgacaacgtttctactctgcttctcactgggcagcaggcagccacaggagtcaaggggagtgttccttaaagtcagcactgagcagtgaacattgacccctaagtacagtgccaccagagggcatcctgcatgcacacgtatgaggaagccaccaggtacttgtgtcgtcgataccttgctggatgttcacaccggtgggggacccattggtcattcacaccagtggtcatcgtacaggggtgttcacacttgttggggaagccagccagtacctgtattatacggtgactatgtggaggtgttcatacccgtggaaaagggtcctgggcattcacccttgtcacaggagagtagtcattgcattcttcacggtgacagtgtgtggtacttacggggtgaagattactgtctcgtagtaggcattggggtccctgcctgtggcttagcctctcctgttctttcttgtgggtgtaaatttccgccagtcacacccacagtgtgcccttcccccccacagtgagggtgtcctggggactcttgcttcttgctctgcactgttttgatcctgcctgttgtgtcagcggtaagtattcttgaacctgaccgaaatggccacacctacctctttgggtttgatctaagaaactccaacagagccctgctgccaccttggtgcctgttgtaatcagggttctctagagcagtggctctcaacctttctgttcctgtgacccttgaatacagttcctcgcgttgtggtgaccccctgaccatagatttcattgctacttcataactggttttgctactgttgtgaatcatagcataaatatctgatatgcaggatagttgatatatgtcacccctatgaaagggctgcctctaaggggttgcaacccacaggttgagaaccattgctcaggaatttgtgtgttacacatacatacgtgtgtatatgtgtatatatacgtatgtgtatatatgtgtatttgtatatatacaaacatatacatacgtgtatgtatgtgtatatacatatgtgtatagcagaatttattaagaataagctttttaaaatatttgttttatttatatttcacatgtgttataatgtttggtctttgtgtatatctgcaccacagtgcttgcctggtatctgcagagctcagactagagacaggtgctcgtgagccac

SEQ ID NO: 122 - DNA, 8388 bp, Mus musculus
  misc_feature 109, 8173, 8180, 8302, 8343, 8359, 8384: n = A,T,C or G
cttaaaaaaaaaacccttacttgtggttaaaggaaaagaaataaagacttaggaaaaatgtaattttccagggggtacctacacccaagacatatggttctcaagaggnactcagcatatcactttgattccagagaagctacaaaagtcattaccaaactccaggctggaaagcagtgctcatactaaatatttaaacatttaaagacctgattaagagacatcaaaggctttataccaggggcacaccaacagagacaggctttttcaaggataatttatgtctgcccattgtcttctggcttaggagacatagagggaaacatcacctaggaaaaccagtaaccaatgtgtaccatccaggagttattctatgacaaaaccaaaagttttgttcttgtgtacttctctgtgcaccatctttctatatctatttagaaaacaaaacaaattttggtaacacgcttgtgtataaagagcaggacagcggtgtcacagatcaacctagaaagtaattatttaacgagtaaatgactcatataggacaaggcaagctgtgactttcaacctgttctgtctcgtgccgaattcggcacgagccaaagcctacctggaccctaccaccatgtcaggatccacacagcctgtggcacagacatggcgggctgctgagccccgctacccaccccatggcatctcctacccggtgcagatagcccggtcccacacggacgtggggctgcttgagtaccaacaccacccccgtgactacacctcacacctgtcacccggttccatcatccagccacagaggaggcggccctcactgctgtcagagttccagcctgggagtgaacggtctcaggagctccacctgcgccctgagtcccgcacgttcctgcctgagctgggcaagcccgacatagaattcaccgagagcaagcgcccccgcctggagctactacccgataccctgctgcgcccatcacccctgctggccactgggcagccgagtgggtctgaagaccttaccaaggaccgtagcctggcaggcaagctggagcctgtgtcacctcccagtcccccgcacgctgaccctgagctagagctggcgccatctcgactgtccaaggaggagctgatccagaacatggaccgcgtggaccgtgagatcaccatggtagagcagcagatctccaagctgaagaagaagcagcaacagttggaggaggaggccgccaagccgcccgaacccgagaagcctgtgtcgccaccacccatagaatcaaagcaccgaagcctggtccagatcatctacgatgagaaccggaagaaagccgaagccgcacaccggatcctagaaggcctggggccccaggtggagctgcctctgtacaaccagccgtctgacacacgccagtaccatgaaaacatcaaaataaaccaggcgatgcggaagaagctgatcttgtactttaagcggaggaaccacgcgcgcaagcagtgggaacagcgcttctgccagcgctatgaccagctcatggaggcgtgggagaagaaggtagagcgcatagagaacaatccgcgaaggagggccaaggagagcaaggtgagggagtactacgagaaacagttcccggagatccgcaagcagcgggagctgcaggagcgcatgcagagcagggtgggccagcgtggcagtgggctctccatgtcggctgcccgcagtgagcatgaggtttctgagatcattgatggcttgtctgagcaggagaacctggagaagcagatgcgccagctggccgtgatcccgcccatgttgtacgacgcggaccagcagaggatcaagttcatcaacatgaatggactcatggatgaccccatgaaggtctacaaggaccgtcaggttaccaacatgtggagcgagcaggagagggacaccttccgtgagaagtttatgcagcaccctaagaactttggcctgattgcctcattcctggagagaaagacggtcgctgagtgtgtcctctattactacctgaccaagaagaatgaaaattacaagagcttggtgaggcggagctatcggcgccgtggcaagagccagcagcagcagcagcagcaacaacagcagcagcagcagcagatggcacggagcagccaggaggagaaggaggagaaggagaaggagaaggaggccgacaaggaggaagagaagcaggatgcggagaacgagaaggaagaactcagcaaggagaagacagacgacacttctggcgaggacaaccatgagaaagaggccgtggcctccaaaggccgcaaaactgccaacagccaaggccgccgcaaaggccgtatcacgcgctccatggccaacgaggccaaccatgaggagacagccaccccacagcaaagttcagagctggcttccatggagatgaacgagagttctcgctggactgaggaagagatggagacagcaaagaaaggcctcctggaacatgggaggaactggtcagccattgcccgcatggtgggctccaagaccgtgtcccagtgtaagaacttctacttcaactacaagaagaggcagaacctggacgaaatccttcagcagcacaagctaaagatggagaaggagaggaacgctcggaggaagaagaagaagaccccagctgcggcgagcgaggagacagccttcccacctgccgctgaggacgaagagatggaagcatcaggcgcaagtgccaatgaggaagagctggcggaggaggcagaagcctcacaggcctctgggaatgaggttcccagagttggggagtgcagtggcccagctgctgtcaacaacagctctgatactgagagtgtcccatccccgcgttcagaagccatgaaggacactgggcctaaacccactggcactgaagcattgcccgctgccacccagccacctgttcctcctccagaagaaccggcagtagcccctgctgagccctccccagtccctgatgccagtggcccaccatccccagagccttcccatcacctgccgcacccccggctactgtggacaaggatgaacaagaagccccggctgctccagctccccagacagaggatgccaaggagcagaagtctgaggccgaggagatcgatgtgggaaaagccagaggagcccgaggcctctgaggagcccccggagagtgtaaagagtgaccacaaggaggagaccgaggaagagcctgaagacaaagccaagggcacagaggccattgaaactgtgtctgaggcaccacttaaggtggaggaggctggtagcaaggcagctgtgaccaagggttccagctcaggtgccacccaggacagtgacttcagtgccacctgcagtgccgatgaggtggacgaacccgaaggaggtgacaagggcaggctgctgtcaccaaggcccagcctcctcaccccggctggagatccccgggccagtacctcgccccagaagccgctggacctgaagcagctgaagcagcgagcagccgccatcccccctatccaggtcaccaaggtccatgagcccccccgggaggacacagtacccccaaagccagttccccctgtgcctccacccacgcagcacctacagccagagggtgacgtgtctcagcagtcgggaggaagtccacgtggcaagtcccgcagcccagtgcctcctgccgagaaagaggcagagaaacccgcattctttccggctttcccaactgagggcccaaagctaccgactgagcccccacgctggtcatcgggcctgcccttccccatccctccacgggaggtgatcaagacttccccacacgccgctgacccctctgccttctcctacacaccccccggtcacccgctgcctctgggcctccacgatagtgcccggcccgtcctgccacgtccccccatctctaaccccccacccctcatctcctctgccaagcatcccggcgtacttgagaggcagctgggtgccatctcccagcaggggatgtcagtccagcttcgtgtgcctcactcagagcatgccaaggcccccatgggccctctcaccatggggctgccccttgccgtggaccctaagaagctggggacagcactgggctccgccaccagtggaagcatcaccaagggcctccccagtacccgggctgcagacggccccagctacagaggctctatcacccacggcacgcccgcagacgtcctctacaagggtaccatcagcaggatcgtcggtgaggacagcccaagtcgccttgaccgggcacgagaggacaccctgcccaagggccatgtcatctatgagggcaagaaaggccacgtcctatcctatgaaggtggtatgtccgtgtcacagtgctctaaggaggatggaaggagcagctcgggcccaccccatgagactgccgcccctaaacgcacctatgacatgatggagggccgtgtaggcaggactgtcacctcagccagcatagagggactcatgggccgcgccatccctgagcagcacagcccccacctcaaggagcagcatcacatccgaggctccatcacgcaaggcatcccgaggtcctatgtggaggcgcaggaggactacttacggcgggaggccaagctcttgaagcgagaagggacaccaccacccccaccaccacctcgggacctgactgagacctacaagccccggcccctggaccctctgggtcccctgaagctgaagccgactcacgagggtgtggtagcaactgtgaaggaggcgggccgctctatccatgagatcccgagagaggagctgcgccgcacacctgagctacccctggcaccacggcctctgaaggagggttccatcacccagggcaccccactcaagtacgactctggggcaccctccactggcaccaagaaacacgacgtgcgctccatcatcggcagccccggccggcctttccctgccctgcacccgctggacataatggctgacgcccgggcactggagcgtgcctgctatgaagagagtctgaagagccggtcagggaccagcagtggtgcagggggctccatcacacgtggggctccagtcgtcgtgcctgaactgggcaagccacggcaaagcccactgacttacgaagaccacggggcacccttcaccagtcacctgccacgtggctcccctgtgaccacgagggagcccacgccacgccttcaggaaggcagcctcctatccagcaaggcgtcccaggaccggaagctgacatctacaccccgggagatcgccaagtccccacacagcactgtgcccgagcaccaccctcaccccatctccccctatgagcacttgctccggggcgtgactggtgtggacctgtaccgtggtcacatcccattggcctttgaccccacctccataccccgagggatccctctggaagcagcagccgcagcctactacctgccccggcacttggcccccagccccacctacccacacctgtacccaccttacctcatccgcggctaccctgacacggcggccctggagaaccgccagaccatcatcaatgactacatcacctcgcagcagatgcaccacaacgctgcctccgccatggcccagcgtgctgacatgctgaggggtctgtcaccgcgagagtcctcgctggccctcaattatgccgctggcccaagaggcattatcgacctgtcccaagtgccacacctgcccgtgctggtgccaccaacgccaggcacccctgccaccgccatcgaccgccttgcctacctccccactgcgcccccacccttcagcagccgccacagtagctcaccgctgtccccaggaggccccactcacctagctaaaccaactgccacatcttcatcggagcgggaacgggaacgtgagcgggaacgagacaagtccatcctcacgtctaccactacagtggagcatgcacccatctggagacctggtacggagcagagcagcggggctgggggcagcagccgccccgcctcccacacccaccagcactcgcccatctccccccggacccaggacgccttgcagcagaggcccagtgtgctgcacaacacgagcatgaagggcgtggtcacctccgtggaacccggcacgcccacggtcctgaggtgggccaggtccacctccacctcttcgcctgtccgcccagctgccacattcccacctgccacccactgcccacttggtggcacccttgaaggggtctaccctaccctcatggagcccgtcctgttacccaaggagacctctcgggtcgcccggcccgagcgggcccgggtggacgctggccatgcctttcttaccaaacccccgggccgggagcccgcctcctcacccagcaagagctccgagccccgatccctagcaccccccagctccagccacacagccatcgcccgcaccccagcaaagaaccttgcaccccaccatgccagtccggacccgccggcgcccacctcggcctcagatctgcaccgagaaaagactcaaagtaaacccttttccatccaggaattggaactccgttctctgggttaccacagtggagctggctacagccccgatggggtggagcccatcagcccggtgagctcccccagcctgacccacgacaaggggctctccaaacctctggaagagctagagaagagccacttggaaggggagctgcggcacaagcagccaggccccatgaagctcagcgcggaggctgcccatctcccacatctgcggccactgcccgagagccagccctcatccagcccactcctccagactgccccaggcatcaaaggtcaccagagggtggtcaccctggctcagcacatcagcgaggtcattacgcaggactacacgcgccaccacccgcagcagctcagtggcccccttcccgcccctctctactcctttcccggagccagctgccctgtcctggatcttcgccgcccacccagtgacctctacctcccaccccccgaccatggcaccccagcccggggatccccccacagtgaagggggcaaaaggtccccagaacccagcaaaacatcggtcctgggcagcagcgaggatgccattgagcctgtgtccccaccagagggcatgactgagccaggacatgctcggagcactgcgtacccactgctgtatcgagacggggaacagggcgagcccaggatgggtctagagtctccaggcaacaccagccagccgccaaccttcttcagtaagctgactgagagcaactccgccatggtgaagtcgaagaagcaggagatcaacaagaaactcaacacccacaaccggaacgagccagaatacaatattggccagcctgggacggaaatcttcaacatgcccgccatcactggagcaggccttatgacctgtagaagccaggcggtgcaagaacacgccagcaccaacatggggctagaggccattattagaaaggcactcatgggtaaatatgatcagtgggaagagcccccgccgctcggcgccaatgcttttaaccctctgaatgccagcgccagtctgcccgctgctgctatgcccataaccactgctgacggacggagtgaccacgcactcacctcgccaggtggaggtgggaaagccaaggtctctggcagacctagcagccgaaaagccaagtcgccagcaccaggcctagcgtccggagaccgacccccttctgtctcctcagtacactcagagggggactgcaatcgccgaacaccactcaccaaccgtgtgtgggaggaccggccctcatctgcagggtccacgccattcccctacaaccctttgattatgaggctacaggcaggtgtcatggcctccccgcccccacctggccttgcggcaggcagcgggcccctagctggtccccaccacgcctgggatgaggagcccaagccactgctgtgttcacagtatgagacactctcggacagcgagtgaccacggattgggggggagcggtgccaggtcccgcacaaggcagaagcagcccagcatggagcagacagctgctgactcccgagactgaggaaggagcccctgagtctgcctgcgcgtccatccgtncgtcgtncactcatctgtccatccagagctggcattctgcctgtctaaagccttaactaagacttccaccccgggctggccctgcgcagtgaccttacactcaggggattgtttaccttggtgctcganaagggggagtggacaggaaggggagggacaagccgggccangagggggggggacaancaattcgtgtgtcaagtcgcactcntgct

SEQ ID NO: 123 - DNA, 3596 bp, Mus musculus
  misc_feature 2043, 2125: n = A,T,C or G
gagtcctgacgcggctcgttgggtcaggcagcaagaagagccgcgcggagccctgggtcccacagcccagccgtttagggacacggctgcctggccctgtcttgcccggggcttttggatttcttgtggcttggtgggtctgggggctccgggacagcaccctcaccaagtgtcctctctgagacactggtgcctggaagatctgcggacgccgcgtgcgcactggtgacgcctggcacagagaaacccagcacacagaactgacaacttcccgctgctgccgtagccctcgctcccttcccaagcaggaagggcactgctctgttctttggggcagctggtagctgcagccggaggagtcctggggccatccccagtgcctgcttttgccctctcggctcctgaggatgtgaacagaggtagaaccgggggataccagcaagaagccctaaggagccttgcggccacagcctcctaatcaccgctccgctccctggagcatccttccagccggatgtttccggaaaacttggccgagggggagacgcagatgagaggatgcctcctggaacatgggaggaactggtcagccattgcccgcatggtgggctccaagaccgtgtcccagtgtaagaacttctacttcaactacaagaagaggcagaacctggacgaaatccttcagcagcacaagctaaagatgccgggaccaggcctcagacatagggcgtccccagccgtgaccgctactgtcctgtcccaggagaaggagaggaacgctcggaggaagaataagaagaccccagctgcggcgagcgaggagacagccttcccacctgccgctgaggacgaagagatggaagcatcaggcgcaagtgccaatgaggaagagctggcggaggaggcagaagcctcacaggcctctgggaatgaggttcccagagttggggagtgcagtggcccagctgctgtcaacaacagctctgatactgagagtgtcccatccccgcgttcagaagccatgaaggacactgggcctaaacccactggcactgaagcattgcccgctgccacccagccacctgttcctcctccagaagaaccggcagcagcccctgctgagccctccccagtccctgatgccagtggcccaccatccccagagccttccccatcacctgccgcacccccggctactgtggacaaggatgaacaagaagccccggctgctccagctccccagacagaggatgccaaggagcagaagtctgaggccgaggagatcgatgtgggaaagccagaggagcccgaggcctctgaggagcccccggagagtgtaaagagtgaccacaaggaggagaccgaggaagagcctgaagacaaagccaagggcacagaggccattgaaactgtgtctgaggcaccacttaaggtggaggaggctggtagcaaggcagctgtgaccaagggttccagctcaggtgccacccaggacagtgactccagtgccacctgcagtgccgatgaggtggacgaacccgaaggaggtgacaagggcaggctgctgtcaccaaggcccagcctcctcaccccggctggagatccccgggccagtacctcgccccagaagccgctggacctgaagcagctgaagcagcgagcagccgccatccccccctatcgtcaccaaggtccatgagcccccccgggaggacacagtacccccaaagccagttccccctgtgcctccacccacgcagcacctacagccagagggtgacgtgtctcaccagtcgggaggaagtccacgtggcaagtcccgcagcccagtgcctcctgccgagaaagaggcagagaaacccgcattctttccggctttcccaactgagggcccaaagctaccgactggagcccccacgctggtcatcgggcctgcccttccccatccctccacgggaggtgatcaagatttccccacacgccgctgacccctctgccttctcctacacaccccccggtcacccgctgcctctgggcctccangatagtgcccggcccgtcctgccacgtccccccatctctaaccccccacccctcatttcctctgccaagcatcccggcgtanttgagaggcagctgggtgccatctcccaggggatgtaagtccagcttcgtgtgcctcactcagagcatgccaaggcccccatgggccctctcaccatggggctgcccccttaccgtttaccctaagaagctgagccccattcagtggagtgaagcaggaacaggtgtcccctcggggtcaggctgggccacctgaaagtctgggagtgcccactgctcaggagaccctctgtgctgagagggacagcactgggctccgccaccagtggaagcatcaccaagggcctccccagtacccgggctgcagacggccccagctacagaggctctatcacccacggcacgccctcagacgtcctctacaagggtaccatcagcaggatcgtcggtgaggacagcccaagtcgccttgaccgggcacgagaggacaccctgcccaagggccatgtcatctatgagggcaagaaaggccacgtcctatcctatgaaggtggtatgtccgtgtcacagtgctctaaggaggatggaaggagcagctcgggcccaccccatgagactgccgcccctaaacgcacctatgacatgatggagggccgtgtaggcaggactgtcaccctcagccagcatagagggactcatgggccgcgccatccctgagcagcacagcccccacctcaaggagcagcatcacatccgaggctccatcacgcaaggcatcccgaggtcctatgtggaggcgcaggaggactacttacggcgggaggccaagctcttgaagcgagaagggacaccaccacccccaccaccacctcgggacctgactgagacctacaagccccggcccctggaccctctgggtcccctgaagctgaagccgactcacgagggtgtggtagcaactgtgaaggaggcgggccgctctatccatgagatcccgagagaggagctgcgccgcacacctgagctacccctggcaccacggcctctgaaggagggttccatcacccagggcaccccactcaagtacgactctggggcaccctccactggcaccaagaaacacgacgtgcgctcaatcatcggcagccccggccggcctttccctgccctgcacccgctggacataatggctgacgcccgggcactggagcgtgcctgctatgaagagagtctgaagagccggtcagggaccagcagtggtgcagggggctccatcacacgtggggctccagtcgtcgtgcctgaactgggcaagccacggcaaagcccactgacttacgaagaccacggggcacccttcaccagtcacctgccacgtggctcccctgtgaccacgagggagcccacgccacgccttcaggaaggcagcctcctatccagcaaggcgtcccaggaccggaagctgacatctacaccccgggagatcgccaagtccccacacagcactgtgcccgagcaccaccctcaccccg

SEQ ID NO: 124 - DNA, 8858 bp, Rattus norvegicus
  misc_feature 1, 2, 3, 4, 5, 6: n = A,T,C or G
nnnnnnactcttcttctgaagagttaagcactccgccatgcgcgccccgcagcggcccgcgcgcccgggccccgcgtcgtagcgcggcgggcggagaccgcaggctcctagccggtgcccgccgcgtcctcgagcccgatcggcgccgtagcccggcgccagcgcccggtgccgccgccggcgagcgctcctgagtctttgaggaacacagcctcccggtggaagtttctggtacctgtgacgaggtcaccggccagcagatgaccgagaccagcccctagtcctaggtgtggtcaagagtgtattgggttccaaagccttcctggaccctaccaccatgtcaggatccacacagcctgtggcacagacatggcgggctgctgagccccgctacccaccccatggcatctcctacccggtgcagatagcccggccccacacggacgtggggctgcttgagtaccaacaccaccctcgtgactacacctcacacctgtcacccggctccattatccagccacagaggaggcggccctcactgctatctgagttccagcctggaagtgaacggtctcaggagctccacctgcgccctgagtctcgcaccttcctgcctgaactgggcaagcccgacatagaattcacagagagcaagcgcccacgcctggagctactacctgataccctgctgcgcccggcacccctgctggccactgggcagccaagtgggtctgaagatcttaccaaggaccgcagcctggcaggcaagctggagcccgtgtcacctcccagcccaccacacgctgaccctgagctagagctgacgccatctcggctgtccaaggaggagctgatccagaacatggaccgtgtggaccgtgagatcaccatggtggagcagcagatctccaagctgaagaagaagcagcaacagttggaggaggaggccgccaagccacccgagcccgagaagccggtgtcgccaccacccatagaatcaaagcaccgcagtctggtccagatcatctacgacgagaaccggaagaaagccgaagctgcacaccgcatcctggaagggctggggccccaggtggagctgcctctgtacaaccagccgtccgacacacgccagtaccatgagaacatcaaaataaaccaggcgatgcggaagaagctgatcttgtacttcaagcggaggaaccacgcacgcaagcagtgggagcagcgcttctgccagcgctatgaccagctcatggaggcatgggagaagaaggtggagcgcattgagaacaatccgcggagaagggccaaggagagcaaggtgagggagtactacgagaaacagttcccggagatccgcaagcagcgggagctgcaggagcgcatgcagagcagggtgggccagcgtggcagtgggctctccatgtcggcggcacgcagtgagcatgaggtttctgagatcatcgatggcttgtctgagcaggagaacctggagaagcagatgcgccagctggctgtgatcccgcccatgttgtacgatgcggaccagcagaggatcaagttcatcaacatgaacggactcatggacgaccccatgaaggtgtacaaagaccgccaggttaccaacatgtggagtgagcaggagagggacaccttccgcgagaagttcatgcagcatcccaagaactttggcctgatcgcctcattcctggagagaaagacagtagccgagtgtgtcctctattactacctgaccaagaagaatgagaactacaagagcttggtgaggcgcagctatcggcgccgtggcaagagtcagcagcaacagcagcagcaacagcagcagcagcagcagcagatggcacggagcagccaggaggagaaggaggagaaggagaaggagaaggaagccgacaaggaggaggagaagcaggatgcggagaacgagaaggaagaactcagcaaggagaagacagacgacacttctggagaggacaacgatgagaaagaggctgtggcctccaaaggccgcaaaactgccaacagccaaggccgccgcaaaggccggatcacacgctccatggccaacgaggccaaccatgaggagacggccaccccgcagcaaagttcagagctagcttccatggagatgaacgagagctctcgctggactgaggaagagatggagacagcaaagaaaggcctcctggaacatgggaggaactggtcagccatcgcccgcatggtgggctccaagactgtgtcccagtgtaagaacttttacttcaactacaagaagaggcagaacctggacgaaatccttcagcagcacaagctaaagatggagaaggagaggaatgcccggaggaagaaaaagaagaccccggctgcggcaagtgaggagacagccttcccacctgccgctgaggacgaagagatggaggcgtctggtgcaagtgccaatgaggaagaactggcggaggaggcagaagcctcacaggcctccgggaatgaggttcccagagttggagagtgcagtggcccagctgctgtcaacaacagctctgatactgagagtgtcccatccccgcgcacggaagccaccaaggacgctggtcctaagcctgctagcactgaagcattgcccgctgccacccagccacctgttcctcctccagaagaacccgcaacagtccctgatgagccctgcccagcccctgatgccagtggcccaccatccccagtggcttccccaccacctgccgcacccccggctgctgttgacaaggatgaacaagaccaggctgctactgttccccagaccgaggatgccaaggagcagaagtctgaggccgaggagctggtgattgatgtgggaaagacagaggaacccgaggcccctgaggagccaccagagagtgtaaagagtgatcacaaggaggagactgaggaggagcctgaagacaaagccaagggcccagaggccattgagactgtgtccgaggcgccacttaaggtggaggaggctggaagcaaggcagctgtgaccaagggttccagctcgggtgccacccaggacagtgactccagtgccacctgcagtgccgatgaggtggatgagcccgagggaggtgacaagggcaggctgctgtcaccaaggcccagcctcctcaccccagccggagatccccgggccagtacctcgccccagaagccgctggacctgaagcagctgaagcagcgagcagcagccatcccccctattgtcaccaaggtccatgaacccccccgggaggacacagtacccccaaagccagctccccctgtgcctccacccacgcagcacctacagccagagggtgacgtgtctcagcagtcgggaggaagtccacgtggcaagtgccgcagcccggtgcctcccgccgagaaagaggcagagaaagcttcattctttcccgccttcccagctgagggcccgaagcttcctactgagcccccacgctggacatcgggtctgccttttcccattcctcctcgggaagtgatcaagacttccccacacgctgcagacccctctgccttctcctacacaccccctggtcaccctctgcctctgggcctccacgatagtgcccggccggtcctgccacgtccccccatctctaaccccccacccctcatctcctctgccaagcaccctggtgtacttgagaggcagctgggtaccatctcccagcagggaatgtcagtgcagcttcgcgtgccccactcagagcatgccaaggcccccatgggccctctcaccatgggactgcctctcgctgtggaccctaagaagctggcccccttcagtggagtgaagcaggagcagttgtcccctcggggtcaggctgggccacctgaaagtctgggagtgcctactgctcaggagacctctgtgctaagagggacagcactgggctccactgccagtggaagcatcaccaagggcctccccagtacccggactgcagatggccccagctaccgaggctctatcacccacggcacgccagcagacgtcctctacaagggtaccatcagcaggatcgttggtgaggacagcccaagtcgccttgatcgggcacgagaggataccctgcccaagggccatgtcatctatgagggcaagaaaggccatgtcctatcctatgaaggtggtatgtcggtgtcacagtgctccaaggaggatgggaggagcagctcaggcccaccccacgagactgccgcccctaaacgcacctatgacatgatggagggccgtgtgggcaggaccatcacctcagccagcatcgagggactcatgggccgtgccatccctgagcagcacagcccccacctcaaggagcaacatcacatccgaggctccatcacgcaaggcatcccgaggtcatatgtggaggcccaggaggactacttacgtagggaggccaagctcttgaagcgagaaggcacgccaccgcccccaccgccacctcgggacctgactgagacctacaagacccggcccctcgaccctctgggtcccctgaagctgaagccaactcatgagggtgtggtagcgactgtgaaggaggcgggccgctctatccatgagatcccacgagaggagctgcgccgcacgcccgagctgcccctggcaccacggcctctgaaggagggttccatcacccaggggaccccactcaagtacgactccggggtgccctccagtggctccaagaaacacgacgtacgctccatcatcggcagccccggccggccttttcctgccctgcacccactggacataatggctgatgcccgggcactagagcgcgcctgctatgaagagagtctgaagagccggtcagggaccagcagtggtgcagggggctccatcacacgcggggccccagttgtcgtgcctgagctaggcaagccccggcaaagcccactggcctacgaggaccacggggcacccttcaccagccacctgccccgaggctcacctgtgactaccagggagcccacgccacgccttcaggaaggcagcctcctctccagcaaggcgtcccaggaccggaagctgacctcgacaccccgggagattgccaagtccccacatagcactgtgcccgagcaccacccccaccccatctccccctacgagcacctgctccggggtgtgactggtgtggacctgtaccgtggccacatcccattggcctttgaccccacctccataccccgagggatccctctggaagcagcagccgcagcctactacctgccccggcacttggcccccagccccacctacccacacctgtacccgccttacctcatccgcggctaccctgacaccgcggccctggagaaccgccagaccatcatcaatgactacatcacctcgcagcagatgcaccacaacgcagcctctgccatggcccagcgcgccgatatgctgaggggtctgtcaccgagagagtcctcgctggccctcaattatgccgctggcccgcgtggcattatcgacctgtcccaagtgccacacctgcccgtgctggtgccgccaactccaggcacccctgccaccgccatcgaccgccttgcctacctccccactgcgcccccacccttcagcagccgtcacagcagttcaccactgtccccaggaggccccactcacctagctaaaccaactgccacgtcatcatcggagcgggaacgggaacgagagcgagaacgagacaagtccatcctcacgtccaccactacagtggagcatgcacccatctggagacctggtacggagcagagcagcggggctgggggcagcagccgccccgcctcccacacccaccagcactcgcccatctccccccggacccaggacgccttgcagcagaggcccagtgtgctgcacaacacgagcatgaagggcgtggtcacctccgtggaacccggcacgcccacggtcctgaggtgggccaggtccacctccacctcttcacctgtccgcccagctgccacattcccacctgccacccactgcccacttggtggcaccctcgaaggggtctaccctaccctcatggagccagtcctgttacccaaggagacctctcgggttacccggcctgagcggccccgtgtggacgctggccatgccttcctcaccaagcccccagcccgggagcctgcctcctcacccagcaagagctccgaaccccgatccctagcaccccccagctccagccacacagccatcgcccgcaccccagcaaagagccttgcaccccaccatgccagtccggacctgccggcgcccacctcggcctcagatctgcaccgagaaaagactcaaagtaaacccttttccatccaggaattggaactccgttctctgggttaccacagtggagctggctacagccctgatggggtagagcccatcagccccgtgagctcgcccagcctgacccacgacaaggggctctccaagcctctggaagagctagagaagagccacttggagggggagctgcggcacaagcagccaggccccatgaagctcagtggggaggctgcccacctcccacatctgcggccactgccggagagccagccctcatccagcccactcctccagactgccccaggcatcaaaggtcaccagagggtggtcaccttggctcagcacatcagtgaggtcattacacaggactacacacgccaccacccacagcagctcagtggcccccttcccgcccctctctactccttccctggagccagctgccctgtcctggatctccgccgtccacccagtgacctctacctcccacccccggaccatggcaccccagcccggggatccccccacagtgaagggggcaaaaggtctccagaacccagcaaaacagtcctgagtagcagcgaggatgctattgaacctgtgtccccaccggagggcatgactgagccaggacatgcacggagcactgcgtacccactgctgtaccgggacggggagcagggggagcccaggatgggttctaagtctccaggcaacaccagccagccgccagccttcttcagtaagctgaccgagagcaactccgccatggtgaagtcgaagaagcaggagatcaacaagaaactcaacacccataaccggaatgagcctgaatacaatatcggccagcctgggacggaaatcttcaacatgcccgccatcactggagcaggccttatgacctgtagaagccaggcggtgcaagaacacgccagcaccaacatggggctagaggccattattagaaaggcactcatgggtaaatatgatcagtgggaagagcccccgccgctcggcgccaatgcttttaaccctctgaatgccagtgccagtctgcccgctgccgctatgcccataaccactgctgacggacggagtgaccacccactcacctcgccaggtggtggtgggaaagccaaggtttctggcagacccagcagccgaaaagccaagtcgccagcgccaggcctggcacccggagaccgaccaccttctgtctcctcagtacactcggagggcgactgcaatcgccgaacaccactcaccaaccgtgtgtgggaggaccggccctcatctgcagggtccacgccattcccctacaaccctttgattatgaggctacaggcaggtgtcatggcctccccacccccacctggccttgccgcaggcagcgggcccctagctggtccccaccatgcctgggatgaggagcccaagccactgctgtgttcacagtacgagacactctcggacagcgagtgaccacagattgggggggagcggtgccaggtccctgcacgaggcagaagcagcccagcatggagcagacagctgccaactcccccgactgaggaaggagcccctgaatctgcctgcgcgtccatccgtccgtccgtctactcatctgtccatccagagctggcatcctgcctgtctaaagccttaactaagactcccgccccgggctggccctgcgcagtgaccttacactcaggggatgtttacctggtgctcgagaggggagtggacaggaggggaggccagcgggccgggagaggggtacagtgatcgtgtgtcagttgcacgcgtgcatctggggcagcggggacccaacacaggatgaccaggcacctccatgccactgcctcgccccttaccgcatttggaaccaaagtctaagctgagctcgcggccctgcccctccctctgcccccagcccgctcgcgctctggacagacagacgttcccagcttatcctgccccatcgctgtcatcgcagtccccaaaggccacccagcccacaagactgggagcccatcagaccaggtgggtgcacaaagggccgggtatggcctggggcacggatgtttgcaggaaccggaccgttcattcccggcctgtcgctatggcgatggcggggaaggcaggtgtaaatggtgttggcttacagggtatatttttgataccttcaatgagttaattcagtcgcttcacacaaggaaggactcacccgtgttactgccgctgtgctttggtctctgcttcctgtcccagaggcatgtgccggccaaggcggtggccccaccatacgcaggactggggggcaggggctccggcacacggcactgtgccctccccctcccttccttgggcagaatggacttgatgcgtattctgtggccgctctctgcacggcggcattctgtcatttacacatgttgttccaattaaaaggcaaattatactccagttacaaaga

SEQ ID NO: 125 - DNA, 165001 bp, Rattus norvegicus
  misc_feature (1)...(165001): n = A,T,C or G
ttccctacggacgttcactttagatatcagggggtccgggtgacagggcaacgcagcgcgacccgcgtgctatgaactcgcgtgggcctctccaggatctcatattccagtcactgaaccagatcgtcactggcagtggtccgcggagtctttcccaagggctaatctcccaggcgaggcccagagcgtcgctgagtatctgcgtgcgactctgagggctccgtgggtggccctcccggggcgtcgtctccgcatcccctggacactcctgagttataatttaatagctgaaacgcgattcccgtgaagtctctggggttcgcggaggaggagggggcggggaggtatttgctccgccttcttcggcgaaaaaacgcagctcggggtgcgcgcacggcggcggggtgcgcaggcctggaaggcgtgcatgcgggccctttaaggcggtcggggcgggcttccacgaggctccgcccctcgctccgcccctcgccgccaggagcggagccgcgggcagcgcaggccgggccgcatccccgtacccgcgccnnnnnnnnnnnnnnnnnnnnnnnnnnnnnnnnnnnnnnnnnnnnnnnnnnactcttcttctgaagagttaagcactccgccatgcgcgccccgcagcggcccgcgcgcccgggccccgcgtcgtagcgcggcgggcggagaccgcaggctcctagccggtgcccgccgcgtcctcgagcccgatcggcgccgtagcccggcgccagcgcccggtgccgccgccggcgaggtgagtcgggccgagtgcgcggagggcggcggggagcgggtggcttccgggccggggcggcgcacgcggcggagttggcgcccccgaggggacgggcggcgcggcggggagcgcgcgggggcgcgggaacttcgggaactctcgggaccttgcagggcggtgcaggccgcgaccccagcacccgggaccctgcaggatggagcaggccaagacttagggacctgcggggtggagcaggccgagaatcggggaccttgcgggatggaacaggccgagaaccggggaccctctaggcggtacaggccccgacctgggtacctcctgggtggcgcagcctgaggacctggggactctgtagggtggcacggcctgaaaactggggaaccctgcagggagatgcaggccgggaccagggaccctctgggatgaagcagccgggacctggggactctttagggtggtacaagccaggactcggggaccttctgagatggcatcagctaagacccaggaaccctgcaggaaggtgcaggccaggacctggagaccctcccgtgggtggttcaggtcaggattccggagtcctgcgggcagtttgggccaggaccctggtgccctccggtatgttttgaaggccaggcccggggatcctgcagcatcagggtggcgtagcctgaggactgactgatggactcgtgttttggagagggccagtactcgtggaccctctgttgtggcgcagcttgaagaccaggattcttaggggtgggtggcgtagctctaggacttgggacccctcccggcggctcgccccagggactctgggtgccacaggtcaggatctgagacccctgaggggtggcgcattctaaggacccaaggaccctgtgggcggccgcgccccccctccagtgacgcggcgccgcctcctgttccctccccctggccgtgcagatacttcggatgccactagtttgggaagttgcagatccgagcctagcggggcagccgggagccccagcgcccccagacgcgcgtgggaagcggcctcccctcccgaccttgagggaggagagccgggcgggcgtccagacaggcggtccctcgggcctctggagctgggggcgcctagcagcggcggctgaataatctttacattgtagctttattcgcacagccaggtccacccgccggcgtgcgcgcgccctccccgagagtctggtgcaggcagcgggggcggatccgttcgttctcagcctcctcccttcctctccttctcctcccccctgttggtgagaactggttttattacgattacgttttttttttcctctctctctctctctctctttgcagatttggtggagggatgtgtgagaggggaggtaggagtgggaggcagaggatcccttggggctctgtgggcagtgttagggtggccttggctttgcccttttgaatgtagctctggtctctgcggctgctttgatgaaaggggctctgaggccaggcgcgtgttggggggggtgcatctcaggccactgctggggacttcgtgggtggcctttttttttctttttaattgtagaggagggggcagaatagtcagaggaaggctgaggtggctagaagccctaagcgttctgactggtcctgcagctcagctcctgggttcgaatcttgggtagctgactgatggggcgtgggggcggggtggcagatgacttcacctgtctgtgcttttgggcttctcttctgcagagggtaaaaacagttcccaggtctggggcgcttctgggaaccgagtctttgcagagggtccttgggtaggttactatgactactgttattccagattctcatccttgctctgtctttggattggggaaacccacgagagtgtctgccccacctttgggagctgggagggtctgacggaggaggccctgaggatggagaagggccaggcctcagcccattgagcacaggcaaacacagagttggcagccagctgagctgcattgagtgttggagggggtggtgagggcatttcgggtactgcctagcttccctgcactccttgtccctgtttggaaatttaccgctgtttctttggggtgccaggggagcctgcggtcttaaagtccagacgtgggggtgggaatgagtggccagacctagcctcttcccacggagctatttacgcttgcaggggaatcaatactattgataaacccatgtcggtggtaatgtggctgtcaggccccggtgagggatggagacccctcctgtggctgtgcccctccccccttggtgagggctcatggcttaatcccttcttttttcccagtgaatactcaggctatctcccaaaggtttcctagctctgcaaacaggaactgagctgccatacagctggatctggattgttctgggccagcaggtgcttgccactctaccgctccctctccacagggacccccgattcccggctggaaatgaactcttgtttctggcttgggtcccacccaaaactggtggtggggaatcctgtgttaacctctgagatgggggtgacacccagttaagaggggagattgatccagtgggagcttcccacatgcttatccccaagggctggatctgttttttcttttttttttttctctgtctgcatattttctctgctctgtttcccgttcatgtctccagtactacctagcagcttccccaggtgataccttggggacagtcctccaagggcggtagctttcggcagctggtgattcctgcttaaagtgcccagggtgtgcatgtgcgtgtgcgtgtgcgtgtgcgtgtgcgtgtgcgtgtgtgtgtgtgtgtgtgtgtgtgtgtgtgtgtttgtgtgtatagaggcagctgtctggggaaggcagggctacacaaagccaactggagtgagtagcttagaagacccacctccctggagaggatgagaagcttggaaagggtcaggtgagtctccttaggggaggctgacaattggaatccactttagtaaaccaggtgaattctgttctctgagttggtggatctgcactgcagtagcaaaacagtggcatccaggaaagaaaaaacacacactgactgtgtgccatcgttcagaaagcacttactgtgtgcatggcagcctcagaaagcacataactgtgtgtgccagcgttcggaaagtgcctttgtgtgtgcaccggtacgttctgaggtgggctgtggggacgtggctgtcctattttatagatggtgtcacagaggccctgagaggtttcggtgaccggccttggaagctgtggctaacacctgggttgttcgtggatcacacagcagacagccttggctgcaaagaagggagcaggaactgacctctcctggggttggcacctgcccatctttgcagggctgtgggggagggcagctcagagactgggaacttgttctcccagggtttggagagggggcggtgccagcagcaggctggcatttctttgaagtctcattttatctcaaaacactcatgcaaatttttggcatctgccttggcgacagtgccgtgtttattttgaaatgaaaacaggggtttgaattatttagcatggtgtctaacggggcataaagctgcaagcagggaaccctgaaagaagcctagagctgccgccgccgctgcctcgcctctccctggggaatctggctatggacacttagcctgtgtttggagaggtccttgctcagcctttgctcctgagagcgccacaggtcagaaagtgcagttgtccaaggtcacagggggactgtgtaccagtggtcgcagtgagcaaagacagattcctcctagtgacacatctctgtgttagagcagcgtgctggcaccccacattgccttgctcatgggtccccagctgatcatgaccttctggtccatagatacttaaaagatcatggaagcacaagacagattgcccgatccattatgtctgagctggtggttgattgagcatagctttgtaaagcttccaaaatgtcttcacaagcagtgtgcccaggctggaacctctaaataggacttgttggtctcacctgtcaggttggaaccttgccctccactgctgggatctagtggaagtttggtccttagaaccacagcatcaagttgttctgttctggggaagttacttaacctctctctctaagccttagtttgctcatctgtgagatggggccacgaccattgctgctgctgccaccgctgcttgggtacttaatattctgtgggccacacaagcccatatgtggcttctgatctgctgtcaccatatgtagcttccccattggagagcaagactcaactgaagagtttgtcatggggactcatgtccttgcatatgctgtgtggtcagacaggttatgtttctcttgtctttttttccctgataatccccccccccagtactcatacccacgcccttgggtgctaagcaagcatttgtaccactgagctctgtacccctagtctggaatcctcctgaaggctgctggtaggctctccaggtgactggctagcctagtctcttcccttgaccccaggttgggacttgttatcctctggagactgagggctcctcccctctccctggttggtgactcatggctccgctgcctctctgtgccctgggagctgaagtttcccctcccacctgtaatcaacctgcttggagatcaatagcagcttggaggatgggaatctgctaatgggaataaaggcagcagtggtggtaccttctggtatgttgggggtggtttccccttcctcctttggggtgttttggaaagatcatactgtgacttcctgtgatcctctgttccttcctctcccactgtgtccaaagactcgaagctcctgaacaggtggctttgtttaattttagttcaccgaaacggctttaatggctgcctggttgccctgtgcccagtggctgctgggtgtaggaacgaagccggcagcgagctaattcctcccattctgtgggcttcccatgctccatgctatctcctgtgaatggcttcgtaggcccctggttcccaactcatggcctcagtttttcaccatcctctgacactgtatgtgcagccactggggaattaacagtagagggaatgttctagagtgtcttctgcttcaagtctttgcagcaactgaggttggtggtacccaggactggaaccgttgtaaccactgctcctggttgtttagtccttattggatccagggtcaagccagtgctgggtaagttctctctcagcagagccacatgctaagctttcttcttactctttttttttttttttaaagatttatttattctatataagtacactgtagctgtctttagatacatcagaggagggcatcagatcgcattacagatggttgtgagccaccatgtggttgctgggatttgaactcaggacctctgggagagcagtcagtgctcttaactgctgagccatctctccagccctctttttactctttatgtgggaaacagtctctctcagagtcacccaggctggtcttgactttggagtcctttctgcctcagcctccagagtagctgagaagaactctgctgaacttaatcattaattacaaaggaagtgagaagaagcctgcgggtcggggagccacaggcccatgagcagtgtgactggagagtctgacactctggcgggtggtgatgtctgtgcaccgactcggaccattgccgtgagtctggcagccctgcaaggccaaagtcccacaaccttcctgtttcccctttcccaggcttagcatgggtggctttgtccctgtgcactcactgggtggcaggcacatactgaatagtagctgctgatccagccgggtccctggtgtgctggcatgtccctgacttccctggtcctctggggaggacctgtcttttttttttttttttactatgagttaatataccgcggatgtctttttatgtttttcttttggggggcggggcagggtcttttttagtgttttattactgtgtagagacaccacgtccaagacacctcaggaaagaaagtgtttgagttggagcttgcttacagtttctgaagattagtccccgattgtcatggtgggaaacagacaggcatgggactgaacagtagctaagagttttacatccctgatccaaggcagagagggagggagggggagggacatacaggcagacacagacaagacaggggcctaccatgggcttttgaactctcaaagctccctccctcccagtggtgtacttcctccagcaaggccacacctcccagtccttcccagacagttccactggctggggagcaagcatttaaccatatgagcttattgtggaagccattctcattcagaccatcacaaggtctcactcaatttgtagcccaggctgaccccgaactctcagtggtcctgtctcaggcttgtgagtgctgggatgacaggcatgtgtcaccacagctagccacatgttctcccagagctgctgttcactaaaaaaggtacatactggcaagaagaagtaacgctttctgaaccgcagaaggctccgggcttcctagaaaggcactttcataaaaacaaaacaaaacaaaaaacaaacaaaacaaacaaacaaacaaaaaaacaatgctgtcagggaagacagtggggagcatggaggtgggtactgcttgcaactcccttgggttccattcccaaggcagtcgggctgggtgtgggtgtgtgcaggcactctgatcatgaaccactcttcctgtgtgtccctggcatccattgtatatgtggtcatattgcacactgattgccgtgtcctgggtcatactggtctgttctgatacagagtgtacttacccccagggtttttttttttttttctattcttcttttcggagctagggatcgaacccagggccttgcgcttgctaggcaagcactctaccactgggccaaatccccaaccccacccccagggttcttaagggtgccatccactgttggtcgagggcacctgggctggtgtgatatataaccctccccaccccagtgtcctctcccccaccccccaagtgtactccctccgcttctccctatgtagccctggctaatcttgaattcagaggtctgcctgtctctgccttttttgtattgcaattaagggcgtctgccactaggcctgggctgcattaaaaaaaaaaattctattaaatacagctttcggggtccataaatgtttgacggatctgtctctacataggtggatctggcatgtcgtggggaggtccctaagactttggccccttttgtagcttaatgtacgtttttgtacctgatgacataggccctggagtcatgtagagtattcccaagacccctgcttctggcttgggccagtggctataccccactgttgcattcagtagaagtggctgactctgggcacgatccatttgcttctcaaataacggtgccctgtgttgagtgccgagtggtttctgggtgacttgatgcctgtcattttcagaattctcaccagctcccccctccccgtcccccaagaagagttttttattggatgaagaggaggagtgaggaagagaagaaaggagaaaaagggctctcaccagcttttaacacttcctgttttccctttgcttcggtgactaaagagctctgcaggtctgcgtgggtctgtgtttgggttttttacccatgtcaccctgggtccagattcctttgtcttggctaccagcattgattttatcttatcatggggatccccccccccccccccccgagctggggaccgaacccagggccttgtgcttgctaggcaagcgctctaccactgaattaaatccccaacccctatcgtggggaggtccaggggaaggtgctatgtggggtgtcttgtgtccccagcgctctgtggtggggagggtgctcttctcactgatgttccctgggagaaactgaggctatccagggaatggcttgtctgccctgggcaattgacttggggggtttctacagcccaaagaagaatgtgccctggggtggtgggatgtcaccctttggtggtctgggaccttagagccctgccccatgctttaagactcttctgcttcctcctagactcgcttaggagactcactctggtagcgctggactgggaagggaggggggtgagaaccccagggggtggctgagggcagggacaggtgtggggctctctgtgggtggtggtggggacaccacagcatccaggtggtttgggattagtctttcctgacctggttgggctccatggtcaatctctcttgggaaagtaaccctgaggtcaatctcttggcccaagtggcctcccgggttaattgctccttggcaggtgtccctggggtcagtgtctgctgcgcaggtggccagaggatcaatctgtgtcccctttccccttaccccttaggccagttgtcctggggctggtggctggactggccttctgtctttgagtgcatttggctttctatgacttgtgtatgctctggacccttgaggaagtctatccaagcctaggtctggacaggcctgtgtggctggcggggacttagagcagaggggtgaccttcactccctagtaaagggacaaaaggagccagggggctccccctgcagacttgactcagctgctccaggccaaggctcatgcatgaaccccgggcaggggatacccttcccccaacccctcctctccctcacaacaccccgtctcccctcccacagctgtcttcagggaggacacccccccatgcttcctctcccacagctgtctttggggggatgatagcttccctagttccgagctggctaagagaaagccagggggacacctccttactttaggcttttgcttagtgtggggctcaggtgggcactggcttgcactagcttccctcagaccctttctttagccctgaaacctgctgtcacctagctcaaagcccttcccttgaggcaggtagaggaacatgaggtgaccctacaggtgctcccccacctcctgaatattcgtcttgcttatttccttggagaggcttattctgcagctgcctacccttgtgggtagaatctgccttcgggtatggagggtgacgtagggctggagtttgctctgtggtcttatgtgtggaggtcctctattggggcctttaagtcttaagtgtcagagaccaggcctagagatgtctcaggccccatccgtcttcatgctggcctctgcaaggcccactgagtcacactgagagaatcctgtgtgacctggtatagccatagcagcctgcctggcacacattgggctaatgggaccagcctgttgtgggagagctaataatgggaccggcctgctgtgggagagctaagttggctttggggaccctgaggttctaggagtttgtcctaggcctgctgagccgcataagcacactgtggtctgcgacctgggtggtcccaactgagccttgggaaactgaagttgaacctggttcacctttgctgtcccgaacccttttttcttttctcttttcttttttttttttttcccggagctggggaccgaacccagggccttgtgcttgctaggcaagcgctctaccgctgagctaaatccccaatcccccccccccacccttttctatgtgtggaccaggcgctggcatgggttggtcagtgtctccttcctactggagttctcctcagaggactctaggaggtgaccttcagtggtgagaaagtcctgctgctgcagcgaggtgacccctgaatgcagtggtgtcctcttaagaggggctgataggatggacagaagacataggacagggacagaggcaggactgccatggactgcaggccgctgggaatgtggatggttaaggataagttttcatgggattcccagaaggaccagccctgcccttgagcttggacttccggctccagctgcaaaaccatcaagaactgtgagcccttgggggcttctcgttgccagagtcactctgggaagtggattgtttctcagcagtggccctagctgtccacaccataggatacctttaaaaccccagttgtgctgggtgtggtggagcatgctggaaatctgttctggagaactgaggcagaagggtcacaagttcaaggtccgtctgggctgcatggtgagatcctacctacacacacacacacacacacacaccatggggccagggaagtggcctaaaacaaacctggtgacctgagtttggtccctggaaccccatggagatatggaaggagggagctcactccacagaactgtccttacttaggcttaaacatacatgtcatgcccacgtccccctatatatgaacacataaaaaaagacctaagaccaatgggaaacacttatatacaacagtatgaagtaattttatggttggggaggtcagtacaacatgaactgtagtaaagggtcacagcatgaaaggttgaaacactgctctgatcccggtgcttggaaggatccctgggacttgctggccagccagcctaatctaattggaagggcctgtgccatagcgggagacaccccatctcaaaacaacaacaaaacagggttaggcaggatctgaccagcacttgagatgacctctcacctccatccatatccatgtgtccacacccacacactctcaaacaaaaccgactcagattgatccagctggcccagtggcgagctaggtctggctggcagggcctgtgcagctcaccacccctgccccttctgtgcctgccatgttggccttgacggctcctccttatgtgttcctccaccccagggcctttgcatactctgcctgaggtgtttcccactggggcctctccagctttgcttccataggctcgccctggctgtgtgagagtgtaatgtactaggtctttgtgctgtcctatagtgtgtgagactgtcaccccagctacaccccaagttcctgaatggtgaggatacatggtgggtaccccaggactgccaaggatcggagtctcccatctgtcttcatgtctgatacctttgtctgggttgcaatgcccgagtccaggcacactctttctctgaagctgtgactgctctgggctggagtggaacaggcctaggtacccatgagccccagggtctggatctgtcaagcaggcagctacctttaacagtgtggcatgtatatgggtggatgttgtccttgcatcctggctccttgggaacaggcgtgcacactggtgtgacagctgtgggtatcctgtgtcagatgttcactctgccctagtgccagagctgattggggatattggaaccctactgtgcctctcctggactggtccttccaagtcctggtcaccagagtgcccagttgcccatttttcagatagggaaattgaggcacacagtagtgttactgtcatgtgccattctgagtggcaggtggcctgggcaggaacttttctgtccttgaggtccttacctttgattggctggaacagtccctgcccttctttgcctctggtcactgcagcttgttcctcagggccaccctccaaggctccatccatagctttggctggctctgcggagtgggaggttgaccctgctatcttggcttctccttgccagttattaatagcatccgcagcactgacaggaagctgcattcccccactgtatatgcctccccccccaccccccgtgtccctggcacctgggttccgctattgtccttgtcacagcttcgtgggaacaccaaggcaggggaccgtactgcaggtttgctgtgtgaccttcaggtttgtgctgccctctctgtgccttgagtcccttgtctgggcatctgggctctctgggtgctgaaagagtacttctaggggtttgggagactttgaggtgtggggcattgttgatctgaggcaggggaagctgataagttactgccgtgggagggtcttgggcaccagaggccctcctctattttccggccagaaggtgacagaaaaggctttgaagcaggagtgtttcatggggccctgggtcagcctgactggttgttgtcattctgtccctttgatactgccatgggggtcctgggtcccaagtggtccaagggccagagtggctttgagtggctgtgagactctacctcccctggctaacagccccttcagtcctcactctgtgtgccacttgttctggaaggcccacccgtgtctcaccccgctgtccagctgtaccttgcagagttctgtgcctcgcctggtgacacctggaggcttcacagaagatacaggatccatcgatgctctgattgttcatggcctcagctgtgcagaggagggtgtggaggaggtctccgtagggaggaacttgcaagaaaaacccaaaacccagaatctccgaaagagttagttactccaggatgctgatcgctagctaatttgtttcacctagggggaggtctcaggtgatggcctctacctgaatcacattctcataaaagctagactgtgtgcttggggctgggtatacgtcatataggagacagatctgggcatgccctgtgtgccttgtgggaatggagaggctgagttacttggaccccaaaattagatgctggagttcagagtccatgggtgtggctctgggagttcccctgaggctctgaggtgcttattctggagtcttttaaagcagaacaacagcccccaaatgatgccgagtcttggaggctgtatgttttgacaagggacaaaggggagccaaggctggaaatgggaccaagggtgagtgagctggagccaggtgactgttggtggcatctcactaatgtgtcacagggtctttatgacaaagagactggagaccggggctgtaggaggtggggagcaatgtcctgtgtccctggctacagggaggcccagtccagctacacagtgtcttcctcttcctctgctgttgtatttcttaccctcaaatggagggtggcgatggttttgactgttggctggtcatgttactcgttataaccaaagaagaggcttgtattggtccagcgcttaaccagagctgggggcacagtcacatagatggcgattgtcctagactcaggacatcagtggtcgttgtgtcctgggatctgggggacaggatgtggaacaacaggggagaactgcgtctttctagggactccattggcggggaggctgggggaggctggaggaggctgggggaggccagggaggctgggggaggccagggaggctgggggaggtcagggaggctgggggaggccagggaggctgggggaggtcagggaggctgggggaggtcagggaggtgggaggctgggggaggtcagggaggctgggggaggtcagggaggctgggggaggctgggggaggtcagggaggctgggggaggtcagggaggctgggggaggctggaagaggcaggaaggtctgcggtcccatgtcctctctttgtttttagttccctcaaagctagtgtgtaactgttcctagcggatggccagggaacagtgtgaccctagcttatcccgtgacagactatagtccgttctccaggatgcgctcccacagccacggccttgtctccaaggggcaggtgccctgggttctctgctgcaggcagtgcccagaggccaactccccagctgcaaagagaggcggaaattgccggctcctgtcccaaggcctttgggccggtcgccaggaactggagcagcaattaaatgaagtgagatccttcgatgcacgtgtcatgtcccgcgtgcgtgcatgtgtgtgcgtgtgcatgtgcagaggctgcagggccatagtgggttgtatctgccagcctagatcaggaggaaaggagataggaagcggtgctggctaagatcacagaacattgccatcaggttcctccactgcaggccagcccagtgctgtccagttgggtgcgggcttttcccgcccacatctttctgcttcctcaggccggtgtgtggtgtgtttccctcctggcctggtccccatcatgtcctcctggctgagttcacaggtctcatcattctgcgggagacaaggtgcagcctgctgtcacagtgagccaagtggccccaccagtctgtaggtcagcagtgggtgagcagtgatggcttcgtgtatcacccatactcaggaggataggcctcagaccccaggggcactgcgggaatcctggaagcctcccgccaccatccgtatatgctgggcatgtttaaatcatactgcctcagtttccctatgtgcttgttggtagaactaggaggctttagaaccaagccacttggttctgtgtcatagcttatatccatgtatcttgtctctaggtctgcggcaagacccatgtctcgtgggttggcgtaatttctcgagtagtctcggtcacagacaaagggtgtttcttgtgattggtggatcaagatgggaagaggcctctaaactttcccagtatgcactggggagcaaagagaaataggcgtggggccttccctgaaggtgcctgcctctgtggaggaggctactctgccaaggtatgccttcaccaggcctggcttgagccttggcagctgtccgacagggctggctggctcgcctctgagaatgtttcctgtaggtagggaacttagaaacagaccatctgagcgtagtccagcctcttagagcgtacttgtgcttttgggggacagggaagggactctcttgtacctctttttccttaatgttttgaggcagtgtctcatagcctaggttagctcaggtggggcactgctcatattcctgggatgggcattttggatccttcatactcgtatttatatcctacccaccagtgcctgaacagcccctgttctgcccctccgtgacagccagaaacgcctacagactttgcccagtgtccgtggggcacatgcctcccatggctctttggatctctccagcagggaggccgcaggcagccgagtctgctggtgcccacatctgtttgtaggttctgttactgaaatgcattcagtgtgtgccaggctgtgcagatgccctctctccctgctatctttgtcttggcatttcagtgtgtgtgtgggggggtggagtatttggaggtgggggcaggtggtccagtgaggagcagtcagcctgggtttgtcgcccaccccagtatccctatccagagaagggccatgggctgctttgggattcaggtgagcagcgttgcccaggacgtggagctcctggtggttggccccgctgcaccagcagacatcagcagccttctctgcaggccctctcagcacagatcctctggggattaagtgggttcatttgatcaagaacgtgaacttgagcgggctgcttatctcctttgagataaaagctgggtaggccgtgagccacctggcctggggaggaaggtgcaggattttagcctcccttctgctctcccttcgagggccctggggcttccctgctggccagcatttggggactgttcactgtgaaccaagtctgcggctgtgcccagctgaggaagcctaggttctgtctacctgtatactccgttttcgggttttgaatgaagtcctgaggtccagggaggttagtggacttgtccagaagcccagcccttgacaggaggtgtctggaagctttagtgcaaagtgggagtggctggacacagtccagggaagggaagctgtgtgcgttggtgctaaagggcttcagcgccgagcagacacaactatagagatgaaaaccctggggcgttagggttttcccctaacctaagagtttcctccagagagtggcgaggcagagtggggagcacagggaggctcagagctgtgctgtgtgcattggagtggtaaagacctgtcttgtctcggtgcgttattaaaacccttggagagcagggcggtggtggtgcacacctttaatcccagcactccagccacagagggaggtgggtctttgagttgaaggccagcctggtctacagagtgagttccaggaaagccagggctacagagaaaaacagtgtcttgaaaacaacaacaacaacaacaccaccaaaccaaaattaaaaacaacaacaataaaacgcccttggaatctatgcactgatgtaactggaggcattaatcaattaccgtgaatctgactggctaggctgaaatgcacacagagatatccatgctcatgggagatgaagaggagaggatggtccaggatgggaggtacaggtttcttgcactctctgcccaagttccccaaagtaccctaaaaatagtctatatannnnnnnnnnnnnnnnnnnnnnnnnnnnnnnnnnnnnnnnnnnnnnnnnngcaggtgtccagtgaggaagcagtcagcctggtttgtcgcccaccccagtatcctatccagagaagggccatgggctgctttgggattcaggtgagcagcgttgcccaggacgtggagctcctggtggttggccccgctgcaccagcagacatcagcagccttctctgcaggccctctcagcacagatcctctggggattaagtgggttcatttgatcaagaacgtgaacttgagcgggctgcttatctcctttgagataaaagctgggtaggccgtgagccacctggcctggggaggaaggtgcaggattttagcctcccttctgctctcccttcgagggccctggggcttccctgctggccagcatttggggactgttcactgtgaaccaagtctgcggctgtgcccagctgaggaagcctaggttctgtctacctgtatactccgttttcgggttttgaatgaagtcctgaggtccagggaggttagtggacttgtccagaagcccagcccttgacaggaggtgtctggaagctttagtgcaaagtgggagtggctggacacagtccagggaagggaagctgtgtgcgttggtgctaaagggcttcagcgcccgctctgcaggacagctttaatggccaaagcttgtgtggggtggggactcggatggcgtgggactttcatgggcagagccacaatcatttctaccagtttctaggatgtctaggggaggggcgttgccatggagaccccactgctgtggctctcaggggtaacaggagcgatgataccaccactgtaggttgagaccgcagccacgccacgcacactgcgggtggagaatctttttcatctcagtcactgccgaagccaggccctaaactagagcccaggcctggaacagtgctgccagagatgctgcctccctggtggcttccccagttcttgctacacttttttttttttaacctcggatttcccacatgctgtcccacccacttagaaacctttccctagagacaaacatggagtctgtttgctgccagtcaggcctcctcagctcacgcatggccttttcaggtggccccaggaggtcttggggttgggggggagttagccaattagaacagggtggggccaatggctcccacaggccacgcccacccacaggccacgcccacccaaggctacgcccacccacggggctggcattaggtttgctctgtgattttacaaattcgttctcaggaaaggacttactcagcccacggatctccaaaatgactttcagagaatgtatagagttttacgcacacttgactacgccgtttctgttgtgtgtggagtgcgtgcgcacacatgtggaggtcagaggacaacttcaatgtcattgctccgatgtttctagcattctgggaaggcagtttctcgctgggtcctggactatccgaagtaggctaggctggccagccggggagtctcagatgtttctacctcccatctccccatcggtgagaccataggtgcaaccagcacacctgacctcggggtggggctccaaattcaggtctgcacactttggaagtaagtgctttgcccactgagccatcttccctgccccgttgttactttaaagcacatttctttttctcatttaaaaacatcattatgttaccgggaaggtgacttagcagttgaaagcatcaactgctcttcccaaggacccaggtttggttcccagcacccacatggcagcccacagccacctctaactccgggtccaggggctctgatgccttcctctgacctgtcggcactgtatgcatgtgacacacccatgttcctgtaggcagacccaacataaatatttaaaaaaaaaaaaaaaacgatgtcactgatcaaatattactcagcgccaaagtggaatgaaacaccatatcctcgccccctagagacgaggcacagaatgaccttgaatggaagaggggacacccgaaagctcgggcctgtgtgggttgagggttgaagcatccattaaagacggatccatggagaacagaggagccgtggggagggtcctcgagagccttcagtgtggacagggtcactttagggtagcagaacgttctggaactacatagcaatggttgcccagcgttgggtgtgccaagcacccttgaattctttactttgtaatgacttccatgcatttcatctcaataaacatgtgtgaaaaccagtgtttatttttttatttatttatttattttttttggttctttttttcggagctggggatcgaacccagggccttgcgcttccttatttttttatttttaagtgaatatttattctgggggctggagagaggtgctcagcgatttcagaacattttgttactcttgcagaggactcaggtttgagtcccagcaccagttgcagagggtccgatactgtactcttctggtctccacagattttttttcacactgtggtgcacagacatagactcaggcaaaacatccataaacatgttttgaaaattacacttaatttatttacttatcgtgtctgtcggggagcagttcagacacataggctgtggtgcatatgtggaagtcagaggacagcttgcaggggtcagttctcctaaagctatatgggtcccagggattgaactccaggcctctccgccttggcgacaagtgcagtaacctccagttttctttattaatctactgggctcagtaccttgtagtcttgtggtttagtggtgctgcaagatgagagatgggatgttgggccagccagaaaatggtagcggtagaatttgagtttgggcccccaccctatcctaagatgaagagttgatcccagattgtaaggctctggggccttcctgctggccagggatgggcccttgggtgagcttgaatgctaccctgggtgatgagcaggctctcctgattgtgtgcgtttgtcatctggagtcccttggtcctagcacacagtctcccagtggggctgggagagtcacagcccaaagtgggaccctaactggacctggctgtacctcagtactggtcactcctggagtgcagagtgctgtctgtctgtctgtttatctctgtgtgtctctgtcctctgtctctgtttatctctctgtcaccccccctttaccccatgtgaccttccaaaaaacatgctgagctagtctgaaagggcctctaggaagagtgtctcccccacttggcctccacgagactcagtttctccagttgtatgatcagcccaagagggagcctgggatcaacatctcagaatttagagctgcgaagccatgatgtggggtggaggggtactgcggtgtcaccccgttttgtagactggacacgcttgcagcaagcatggggcagcgtgtggtgagtcaggctctgagggctactcctcatcacaagggtatggagcagcctccctcctggatgtaccctgcgccctgtggggttgacagtcgcggcaggcagtgtcagctcatgcaggggactttgtgaatggggtgtaggcggcaagggtctgcttcccacatgacaccttcaatgccagctgcctgttctctctcaggttgcaagactcttgattgtccccggagccccgggtgacagatctctttaatccgcctcttgacccagacaattaattgcattctggagatcgattgtggccctgatctccaccgccgccagagcccctggcccagcacatgcaacccctcgtggcctgttcccgcaccacgggcagaggctggggccctctgcggtaagcctaacttttcccaggctctgggttgagcctcctagtttggtagggattgttggtgattttcctatccagtttggcgactccaccgaggccttgctatatcctctctgcagatgggccccaagggcagtatccccccccccccccatctgctctcctgctctgtgtgccccactggttccccaggccaggaatacacggaggcagctgggacggttaagtcctctctatggggccttgaccccttttcctgcatttccccaaccccgtgtggagagtgggagaatgtgccgggatgtagtagcttagggtgcttgctttgacgtgcctgggagcctaggttctacccctaaaaaaaaaaaaaaaacccaaaactgatgataataatcttaatgataccagagcggcacttgttgggagtgaaggttcgagtggggctgggcccatgtgggtgactgctgatggacaggtggatagcagatggcgtctcgggttgcctgggcctctgtgggctgccggcctggtttgtcctggcctggcctgtgcttggctgtgagccagactgcctctgaccacagagaggccccttccctgggaaggcggcggtcgatgcggcttcttcctggcctcggcctctaattgctccctctggttctgccttttgtagatggtcctcctcccccgccccctcctcatcctgccctgggtgagaagcgagatggctcgtctgagaagccaggtctgagaagcttgattcctgaccctgtgagtgggtggagggggggagcctggttagagggccaggctgccaagtcctgatttgagtgaggatggaggacacgccccatccccccaattctccctgtccctgtggttctggagctggtgtgtgtgtgtgtgtgtgtgtgtgtgtgtgtgtgtgtgtgtgtgtattagtgttatctgttcctaaggctggcaccttcctcacagggtggaggagacattacaatggctggtacaaagcccacatggtggctctgggtattgttcccatggtgtcagtgtcccccgccccttcccgtcattatacccagacagaagaggcttgatgtcttggggagcacgcaggtgcttttggggggccatgtgggacagtgggcatctctgccttccgtttctctcctctcttggtgcagcctgtgtccccctccctctgtcacaaaggccctgtcatgtggtgtccctgccaccccatcccacccccatgctgccggccctctcggccttggtttcacagcccctgccctgctcctgggagggctacaggggtgaggctgctgccatccgcctcctgccgtggccacctcagccgagctgctggagctgagaccttggtggcctccctgtgattgcttctcggcagcttcaaggagagctggggagggagggcaggcgggcgtctcagctgtcacttgagaaggaaaataaaatatccccgtggcttctaaatggaagggcggtggagcggcctcctttgcttcgctgtctcagctgctggctcccacagtgacacaggcccctgggggacagggtaggcttcctgtttacctggtgtagaaagatgtgcccagctgggctctcctcggagggtgggggaattccccaggtcccccggagccttagggatctggccactccagctttggggatccgggttgtattggtccaagtcctgaaacagccatttatctggggttgggatggcgtggggtgtggtgtgggttatcacggaatgctgagggctgggccagatctatgtctggtttagggtttctctcttggtgtgcctgccattgggtctcttggctgtagagctgggggattcatctagggcaagatgggctcctggtaagcactgttaattctccaggtgtctgctggggctgtatagaagcagaggctcctgagtgcagtgggaactgtgccgagtgccttgctccagacgcggagcgcagcagtggtctgggttggagcggggagctgcagggcagggtctgggtcttgcttgtgattgggttccagggtctctgctcatccttactttttttacctggggaccaagggtcatctgtgctatggagggaatgactgctggccaggaagaggctggcagccaatgaacattggtgccgagtgctccctgggatggtcaccagtagacagttcctgtcatccatccagggcacaggatctgggaggcataggcctcgcatggctggatcctcgagtagcacagagctagctaggccttgctcatggcttagatccagactatttagcgctctctctctctctctctctctctctctctctctctctctctctctgtgtgtgtgtgtgtgtgtgtgtgtgtgtgtgtgtgtgtgtgttggggggtgggtgtcagatagtgtcttgggagggcactgcctcaagttcagagattgccctgggagtgcaggctggccctgtcaccccatgcctgtaatgcctacatgtgagaggaggttggtcctccttgtcccctctttgtgccatgctcttcccagaccctgcagaagttcctgcccagggcctccagagctagctggttcttggtcatgagctccttgctgcagcctcacttctgtgagcccttgtcccgttgtaggttccctgagagtttctagagctgcttctcctgttgcccctgtgtgggctgtgtctctgacaagttgctctaaggtctgacctctttctgtgcttatggccacacgtctctacctggcctggagataggggcttgtcccttttttggtggcccattgttctccaggactgcctcttgtcctcctgttactttgtttttgagctgggcagggggacagtcaggtggcttcccagaggaggaggagttggtgcttgtcccattcctgggaaggcagggatggcattgaggggggcaagttggaaattcagccaacgggccttcctttgaggacagcgctgcctgaggcctgggagaggtgtcttggaaaatgtccctccccccagctgctttgctgggaactgacttctaagccccagggggcgggaggggcccttggaacttcctccgggccagaggggggagctggatattagctgggaaggaggggcacccctatactcagtgtgtctgctgcgtgagggctgttagggggcatcctgtggggtgagaggagctgtggatatgcagacaggacttgccaagtgtgcacaggggacaggaggggcaggatggagaggagtgtgcagacttgccatgtgcgtgcttctgagaaaagtgcctatgaagaggaaccagagtggctgtgacccaaacagcccagcaacctgcatgtgccattaccagtggtggagggaatgagtgagagcaagggaaagtgctggaggcttgctgagtgtgcttgtgagcagccaggaacccagagagtgctccccgtggcaggagagtgctccccatggcaggaggcaaggctacctgctaggagtattgcacatgggaactagctattagccatctggattgtgtgagtgtgtactcacctgcgtgtgtgtgtgtgtgtgtgtgtgtgcgcgcgcgtgcttgcttgtgtgcgtctgtgcacttgcacactcgtttgcccctttgcctgcccccttgcctgttattgtttgatctctttcgttgtgataaatcactttgaccaaaatcaacttgtaggggaaagagtttatttctacttaaactttctggatctcagtccgtcattgagggcaatcagggcaagaacttaagcagcaactgaagcaaaaaccatgagaaatgctgcttgctggcctcatgttcagctagctttcttatactgtagagactcacctgcctaggaaatggtgctgcccacagtgggctgtgcctccccataccagtcattagtcagggcagtctctcatagacatggccacaggccagtctaatagaagcaattcttccccagaggttgcttcttgtaggtgactctaggttgtgtcaagttgacaataaaacataggacaaggctgtgtattagctgcaccccatccatcctggttcccagcatccctgggttcaggctctgctgtatcaggggtggggaggataggttccagcctccagcctcagcctccttccagggaagctgggacagccacctcaggtaactgtcagcactaaataaggggctgggataccaggccacccctttgtcctctccctgagctgtccacaggcctgctcatagccccctgtgggcagagttgctctagccctctgttggctttgtggggtccacgtgagatgccttccttcaggtccacgctgatgtccctaatcacccacccgctgtctgctttgtggcatttcctgttggcccctctcacctggtgtggttctcgccacttctactgtcctccagagtggcatgggaccttgttcctccctagccaagatctggctgaaggccttgctgcttaggtcgaaacctaccagatgtccctgtatgggtggccatgttggctctgcccagggccttgcatgggaccccagctatccctgtgtctgctgtgtgtgttcctgccagtctcagccagcatggcacttgtccctctcagcagtcctgctaggactccctaaaagggggaatacctccctcggacctgttcaccactggcccataccgatcctgtacgaaccctaggcactgcattgaaggggtcacaggcagtgagggcctgaaggggatggccctattcccagctgaccttccagggtaggggcctgtcctgtcgccagggagggagggcacccaccttcaagggctggagttgcctgaccgacccatcacagacaggctgcaggtggctggccgccgccaccggaacttctgggagtcatgcccgtcctccccattccagctttccacagggcctgtctctggagttgctgcagatggcggaacccggtgccaagccccggggcatcacagcaaacaaaggcttaaggaggacacagggcagaaagaagcaactgcacggtctcctgtggagcgccggcagctgccccttcaagcctggagtttaaggggcctgccagggcaggcagtgtgggagtgcagggcctggagctgtgccgccagccctggattgagtcctggcagtgccagccagcagtcataggagcatgcaggatgcacatccagactcattatatattcagattcggcatgtctgtgaggttgtctctaccactgtgaacgtttcagagatgtgacattaaggcacagaggggaggctactggcttccaaaccgcactgctgggtacctggggtgcttgctccagagcctaaacgtgctatacctccaccttcttcattggcctctttatctttgggggtctagcatagtttggggctgagatgctggtgcattgggaagtgtctcggagatgactttggggggcagcttgtttttcagggaggaccgaggtcaggatgccaaacctgcacagtcacggctgtcagtgccgtatagactctgttacactatccactgcgctttctctctggcgcatccttttgccacacagtaaagaaggagtgaaggttgaatgggcattgtagggtttgtagttttagcctttgggggaggctgaggcaggaggatcgtgagctgctctaagcatgagcctgttgtaggagcaggtctcacagcagacgccttcttggctgtttacagatagcgtcctatttgctgcagcaacgtgtgagtctcagctgcttccctcttgttttttcaacacctgacgtggtggctccagacttaatctgcactctggcagtgtcgccattgtccggttatcagtgcatctgtgctgcatttcagatccagaccctctgctgcccgtctttgcgtggtgacttggttaaggaattttgtttcttttgacctggcagcactggggaattgaaccttaggccccatgcgtgctgggcaggggttctaccacccagccaccccaccacccccgcccttctctgtatgttttagttgtagacaggatctcaccaagttgctcaggccaaccttgagcactgtggagttctctggccttgaactcatgatctttctgcctcagcccccagcgtacgtacgtggtatgatatccctgagttaccgggctctttcggttagggagttgggggtgtaggtggagagtggacctgcctagcaggtgccagttcacttgcttgttcttggggtcctggggcgtcgctggggcagggtccttggtcataccatgttcatagccatgatggtcttttatttaaggtggtccctgtctggggtgtgtgcttcttggaacccaatggggttgaggtggaaaactgggctctgtcctttcttctaaggccagggttgtaggagcgagacttgggtcgcttgagcctcagtctaccactctgtagtgtgtgctaaggcacctccctcgtggggtcactgtgggaagcccttgtccacgtgagacctgtaattttgttagtgacaagacccctgtttttttcccacagcgctcctgagtctttgaggaacacagcctcccggtggaagtttctggtaggttcatcttttatttccactttgctgtcttgggtgtgtgtgtgtgtgtgtgtgtgtgtgtgtgtgtgtgtgtgtgtgtgtgtgtgtgggtccatactgcctgcatcttctgatgatggaagctggcgtagggtgttggggaggcagaggctgtctagcaggcaggagttggtgtgcaatggtgcttggtacctcagggttgcctaggaagaacagggaacagctggggatggtgagggtggggagtccccacccctcctctcttgggagagtttgttctttatccattaatggattagttgtttgttacttcctttcttttgtggtagtggcgatggaacctagacctcacacatgctaggcaagcactaaccaccaagccacacctccagccctctcttttttaaaatatcgagacagggtctcactaagttgccctggatggccttgaactcacgtcatccatccatccatccacctcaggtgggctttgagtgcgagatccttctgccgctgggatgacaggcccgctacttcttcctgaagcacctactgcgtgtaggtggagcagtgggtgaccgagagagcttgctaacaagctgagcaaatgccctgtcagcatgcagccagcggtcggcaagcctgatgggaggcaccgctgggtaaagaatgagtccagctgaggggagttatgggtgcatgtgtggggtgaggtacagcttcctatggagtctccagaaagtggcatttgaggctggagtgatggctcagtggtagttccagggggtcagaatccctcttcggacctccacacacaccagtcacacatggggtacacagacatgcatacaggcaaatactcatccacgtaaaataaagacggccttggattgaggcctgagaaggggagaaggttggtatctgggggatggtatttagacggagggtacacggcccacgtaaaggtcctggtacagtcttcactggactctctggctgggactcctctctctgtgttgagccctttacaggcaccccagtagtcgggagggggagggatgtgtatccttccccgcccccaccctggccagcagggccatggttcctctccctcctctttcaggctggcattaaacttgctgtgcagccctgaacttctttcgaattccgttgtctgtgtacagttaggtgtgtgggccgccgcgtgcggtgtgtgtggtgtctgggcgttctaggcaagccccgcaccaaccagccacttcttggagccataggctgtggcttcatctgaggagggaggtgggcatgagtgtgggggcggggctgtccaccgagtctttgagagtggaaagaacatctcggttgctgctgcccgcacccccccaacccccatccatccgcatctcgctgcctaatggggagccacctcagcctgacttatctgcctgtcaggccagtggcccacccgaggacgataaaagggctttttgtctgcaagcacttagcttcctccactggggcgatccatcatgcttgtgggaggagggaagcagacagagggggagggcggggagccatggacccaggcagctcctcagccaagacaaggctgtctgggaattgcaggagcagactagagatgtcctaagccccatccccttgggcagagggccctgaggtcttttggagacccttgtgccttgggaaagtgtgctgagggagaggggatggaagtctgcatcataagcctatacacaccctcaggtccctgctgaccactttgtgggatgaccttattcgatctccagagtattccaaaagtgccatgtcactgttcccacattacagatggggggtggtgaggctgggaagtgacatgaggtccccacaccgctctgaaccgcggaggaccttggggttctatggtgggcccagccgtggtgttgttctgaccttgcagtgggaagcgggggctgggaggtagagagaggcttgtattggggggaggaggctggtggggagacaggccagtcaggagtacagtcagggtaggcaggtaagcgcccagagctcagcgggcagattctgggatgtggtcagcgggctcacactttggtttgtgtttcccacctggagagcagcatggttttgttctcaagccctggctgtaaatatcatggggcggaagagcgcaggactcccctcccttctttgtgggtcagtctcctccatcctctggctccttcccagctctgggtgctgagccctggccgggctcctgccttccttccctgccctccccttccctcgtctctgccctccctcccctcctttccccctcttcccctagggccaccctcaaatgacagcaattaatggtacctgtgatggtggagtgtgacagctgagctgcctgtctgcagctgccctgctaatcgggcccgggggacccccctcctgctagttctatgcatggcctcccctttgctcactgggtcgcaagggccaaccagcagtaggcctgtgggaggtggcagaattactccaaccctgcagcttctccctctggctgtcctcttctgtcatcagggcgactcttgtgcctgaccttgtgctccagcgagcgtggctgtggcagtgggcaccccagttgcccactttcctcacacgtcctattccaggactgatgctggcctgaaatgaccctcgccaggagccgttctcacaggcttctatgcttcctgtctcctgaagggagatggttcctgtggaatcagaaccttgccctgccctggatggacatcatccgtccgtcagattccctgggctcatcctgggggacctggaggcagctactgagtcctgcctgttgccttggctcaggttaaaaggatcccagcatgtcctgcccacactgggctttgcccatccatcattttacagcagcagtaatagggctcctgctgtataccaggacctgcagccagtgcttccgccttggtttattttagggcttaaaaagatcttgacatttattgtgtgtgtgtgtgtgtgtgtgtgtgtgtgtgcgcgtgtgtgtgtgcgcgcgcgtgtgtgtgtgtgcgtgtgtgtgtgtgcgtgtgtgtgtgcgcgcgcgtgtgtgtgtgcgtgtgtgtgcgtgtgtgtgcgtgtgtgtgtgcgtgtgtgtgcgtgtgtgtgcgtgtgtgtgtgcgtgtgtgtgtgtgcgtgtgtgtgtgtgcgtgtgtgcgtgtgcgtgtgtgtgtgtgcgcgtgtgtgtgtgtgcgtgtgtgtgtgtgcgtgtgtgtgtgtgtgcgcgtgtgtgtgtgtgtgtgtgcgtgtgtatgtaaatatgcattctcgaacagagtgtgcctagcttccttctttacccatggcggctctgagtttgctcatttctcaccctgccggctcactttttctcttgccaaggatggttccgtcttgtgccgtccagcagcttgctggtctggccgttcctagctgtggcttgaagaaagttcccctggaccattcctgcttgagtctctgtgaacatgcttccatttctggatacacacttcttggtgtgggttgctaggtccgtggtaagtgtggagaagggctgttggatgaagcaccgtctcactttgtgttcccaccagcagggtgtggggttgcagttgccctgcttccccgcctgcacttgagactctcggtctgttccattaggtctgttccattagccgcttgagtgagctctgtagcgtttttcgattatacttcaacattggctacattttgattctctgtctggccagctggtgggtggtagaaagcttggctggctgagacagtcacacacctgccagtattgatggctctgtcgtttctttgtagtaccaggcgatgacttaacttttcttaccgtgtggaccaggaccatggtgtgttgttgaatggcagctttcagggttgccatgtggtggctgttctgaatgtttccagccaacagatgaggaaactgaggtacctagaggccagatgatttctcccacaggaggaaggatagttggcagtcagaagtacagcctgcacactttctcccctatgtcaggaagttccgactccaagtgttacatggatgcgtttgtggagctggagggtcgagccaagaattgatggccaggcagggccagaactcagccttccctccggggtttcctttgcttcagagccaagggtgtggaggagagcccgggcctccgggttaagccctgtcctttggcacccggtactgtgaagcaaacgtcaggctgtgctctgccaagggtctgctctcatccagtccgctatcttgagcaaaatcacagagttctggggagctattgtggggcaaggtagggggccagctgctcagaagcccaggaaacagggtggcagcagaggagggcgtcctgctctatccaacaccccccttccttgcctgagggggtgtcggctaagacgacttttcaggggaagaaggcccgtaaatcaaataagcaatcccgtaaataaataagtaatgaagttagtggggtgcctaattacatcagagtcgtaattacggatggatgcctgcccgataattggacttgtttttaatctttggctccgacatgtgtctcctccatctaacggtggtcgttggccccagctggaggcagaggaggcgctgtttcggggcctttgtgggctggtggttgggtgtgtgggtggtgtccgtccgcacagggttgtgtgctgggtcagccttggctttatcccatggttggctttgtaagctgactcccgttctgaagtcacttcgagcgtagacaatgacagggatgataatagcatcggggtttataatggcacccacagtgcagttaatgatagcttatttaacctccaaaccctctggaggactgtcgtcccttctttatgcatgagacgcaggcacagagaggtttagtacctcatccaaagtcacacagctcccaggtctgggttcttcttgcctcagcctctaggttagcctatgtagggcatctgaggtactttccctgtgttgagtggcagtgggagctatcctgtcatcctgtgtgatggccttaaatccaccagtgaagttattctgagctgtggagatcttgcatcccaccaaggacaaagccacctttgtgtctcctccctctgataggaggctgggggaggaagaccagagtgggctcccactgctggcaggcactagggccagggctctggggttctgatcacttcaatcaacatcctggtggagagcagagccaggtgtgatgggacagggcggggagtgacatgaccacgaccaggggtcatggtgactcaactctgtggtgttggggtgtctttcacgcggggaaccagtctgggtttgtcacagactttcaccttacttcaggaacgcatttgcatttgagcatgtgacatgttctgggacacttgcaggagcagagcggtgggacaggtaggcactgcgagtgccctgagggattatcagattcccaagtaagtgtcctggaggctgatcagggccagaaggtgtgagatgaggcatgaacccaagtggttagggacacttagggctcctgaggtcaggggcagatacaccgaggtcacggcagacgccagaaggaactaaccgatgggtggaaagtcccgaagaggacgtgttgagacacagccaccagctgggtccaaaaggacagacactgccttgggggagctgccaccactgtctcagctctgtttccttgtgtggtgcatgtccttacctgcagcccactcctgccaccaccccaggggagggagcggcatctagaacccaagagggtgcaacttacttgcctgttttctccccagtgaattctttaacacctttcttcgcctgcagggagaggcggctaaggggcggggtggtcttggtgtgttcacgggtgtccccgactcagaaaggcagtcagtgagcccaggctgggggttggggttgagcccagtgccagacactccgagcaaagaaaactagacagccgcacttatgtgaagcatcttaagtcggaaaacagtagccgtgtgggccagagccttcctgctggggtaactagctgtcacctccttctttttctatgacctgtgactttcatctcaaagtatcttttttcttcccctgtgatctgggcaagtgtctcatggaatgttccagaaagttcccagtctggagaagtcacgtctggcacctctgcagatgctgtgtgagagagtcagggcccagggttacagtcttccctactgagcgatcgttcaggtacagtggggcctgaggagcaccagaggacagcaaccccagtggttagtgactaaccttgccgtgttgttccaggggcaggtccgtcttctgctggctgactcagtttttccatctgtgacatgaggatagctgtgcctttagggatattgtgaggaatcaaggatcttgcttggctcatgaacctcaatccagtggaaatgttgggtacctcatctctcagtgactgctgcccagatgtgggtgttcaggatcccgggcagtggctgctgccttccatggctctgactgtggctgcgggggaagacctcgttggctggcagccctgctggagaggatggcccctttgggcataaggtggtgcaccacagccttggtcctgctgtgctgtgtgtactgggccaagtatcattctactgcagtgtgggacatctgcaccagcaggggacagggatgaggggatcccttccctccagggtagaactgggtacctcatgcctccctggaagggggttggactctatggcttgccttgctggatctggcaggcagtgggcagttatgtgggcttgtggcttttgttggcttgggagtggtgttcctattggctcccttgggcccaagggaggggtgggggaggggagggcgagaaggctatagctcagttgagtcctgagctgcgatctgtgggtagaaggtcttggtggaccagcctgaattgtgacggacatgacatagtgtcggatgccctgagagtccaaggagactctgtgggtcagtgcataggcggctgatgctgccacagctcagggacatcaggcaccaggactgaggggtccgagtgcagtgcccttttttacacacctggggtgggagtatggccctacacaccctgagtttggacctcctttaggtcccatctcaaatccccagtagctggtcacctgtcaccgtggccacgtgggcgagcgcacgtgtgggttttattttaacttcacatatattggaagagtttgtgctgctgtcatgtgcacggtgctccatgttgcttgaatgggggccaggagtcctggggcgtggggtgcttcgctgtgaggctcggccctcaggtgctttggtgtgtggtactccacacccctgatgcttggtttttattcaggtagagagtagattcatctttgttgttgttggtttttttttttttttccggagctggggactgaacccagggccttgcgcttcctaggcaagcgctctaccactgagctaaatccccaacccctgttgttgtttaaagactgagttttactctgtatctcggattggcccgaactcaaagcagtcctcctgccttagccatcccaagtgctaagatggtgtttgctaacctgtcgggtaagattaacctttaattttttttttttcctctttgagataagagtctgattctgtatcttaggctgccctcaagcacaactcactgtgtcctaggctggcctcaaacttatggaatcctcctgcctcagctccccctgctttagttagggttacagcatgcaccacatccagagagaggaatcatggtcagtgggtgaccggtgtgtcagctgtgagcactgagaattgcgccttgatcacctctgtccacttataactgcctgtcatccaccccgtgcccttgggactcactgctttacctccaggcccgggtctcgtggatagcctgtccctgggtggtagactctcaggtgagaccttgccccgtgtggctttggggtgctcttctctcaggtccctgcttgtgttggtcttcatttctttttttcttttttttttccggagctggggaccgaacccagggccttgcgcttgctaggcaagcactctaccactgagctaaatccccaacccccgtttcttttcattgtgtggttgtactccattttgtagagatgagtgtctttgcagatggggaaactgagtctagcgtggctccccccaggctgggggggggggcggtgtgaagaggagtgtgggcagtttcttgttctctcctctttcttgctgccctcccccctgcccggccaggaacctcgtctggagagtacgtatgtcgggttggccatggttctctgaggctccagatctcctcactgttgctcttggctggccacgtcacaagccacaggcagtttgccctgcatccagtctcctctttggttcctattgacttgaatctcagcctgtaacctggacttgaccactttctccaacctttcccaccacgtggagctgcacggagcagccaggctgctgggaatggtgtgttgttgatgttggctgatggcgttgccggccgaggatgatggcggtgtctggaaggctctgcctgtagccgcttctggtttttgatgatacatgatcattaagtcacttaacaaacactaagttgcctggtatcttaggagaagatacagctgtgggcatgattgtagaaagggacatgacggggtgatcatcccgctctcactgtgatctgacccggtggggtttgaaactgtacttgtgggtttcagggtaacctttgcgaaaggcaaggttctcctgcagcctctgctggaacagatgcagggtggaaaatgggggatacccctggcccagctgttggcctacgtaacttcctggtagcgtttggatggtgtggctatgactttattctgcgtttcagtgtcctggtgtcacagtgagagccagggacaggagcacagtggttgtaccttggctgaaaagatgggcttcagttgccccactgtttttttgtttttgtttttgtttttgttttttttgttttttggtttttttttttggttcttttttttttggagctggggaccgaacccagggccttgcgcttcctaggcaagcgctctgccactgagccaaatccccaacccctagttgccccactgtttaacgcctcagtttcatttggctatggctgcaggatgggcaacctctctttgccagtgcggttgggtctacagaagcctctgaaagtcccacttggggtatgggcgtcacagagcagtcaggagggatgtcaaggtatttcggactgccaaggtttagatgtctcctctgatttccctatggctgtgggtctttccataaccttcagtggtcacaggcttttgttctgttaatttgccttagtcctgagctgactgaccactgctggctgtggcggtggctgctgctgctgctgctgctgctgctgctgctgctgcttcttcttcttcttcttcttcttcttcttcttcttcttcttcttcttcttcttcttcttcttcttcttcttcttcttcttctccttctccttctccttctccttctccttctccttctccttctccttctccttctccttctctttctcctcctcctcctcttctcctccttctccttttcctccaccnnnnnnnnnnnnnnnnnnnnnnnnnnnnnnnnnnnnnnnnnnnnnnnnnncttttcctccccctcctcctcttcctcctcctcctcttccgtatatgagtagttaattttttttttaaatttttttttatttattcatttattatatataagtacactgtagctgtcttcagatacaccagaagagggcatcagatctctttacagatggttgtgagccaccatgtggttgctgggaattgaactcatgacctctggaagagcagtcgggtgctcttaaccgctgagccatctctccagcccatgagtagttaattttacaatattcttttttttaaatctttatttattttcattttgtgtgcattggtattttgcctccatggatgtcttcgtgtctgtgtgagggtatcagatcccctggagctggagttacagacagttgcgagctgccatgtgagtggtgggaatctaacccaggtcctgtggaagagcagccaattctcttaactctgctgagccaactctctagccccgactggtggcttcttgctggctgtggcactgtgggtactgtcaagacccaggttcaagtcccagggcagtccctttctaggactgcttcctttgggtcacatagctttttcctgggctcacagtggaaggtgggaccactctccatcacgatttggggatggctgtacctgggtaccctgcttggtgtggttgtggtccagctgctgggcacattgctggccttcttgagcagctcccaagatgggtggtggtgcgattgtggctgtggtagctgccccagctggaggccatgcctccttctctcctcctcttggccctccctggcctcatctttttatctttccgaccttccttgttcccatttggcctagctactgctgtgtacatggcctgggcttcctgctggggggcggggcttgcatcattcagggagcacactgttggcctgactcctgggtgctgcgaacaggagaggaagtgggagccatctgagaccctgaggttgtcactaacagagtagttctcaacttgtgagtaccaaccttttcacagaggtcgcctaagaccgtggaaaaacacagatatttacattaggattcgtaacagcagcaaaattacagttatgaagttgcaacacagataattttatggttggggggttcgccgtaacacgagggactgtatcaagagactgcagcattggggaggttgagaaccagcaccccacagctgcagagccagccttcagaagatgcacagcccacacccagaggaggtcaggcttgaggtgagtcacccagcaagtcacagccagtgctgacgcctgcccaagcatccggccatctcttctggcctctgtgtgcgcttggctctgcctttttctgggcctgtcaccgagatgacccgtgctctgagcctcaggccccgtttcctttagttgagatgggaaggacgggaaggacgggaaggatgggtgctttttcctctggccatctgggcctgcaggactggaggacgtcagggccggctgggaggaaatggttaaaggacgggaggtggctggcgctggtccccctgccagcagcaaggagggagagggcttctcaaaagctataaaaaggcctcgcagtgttgagccccagtggctggaagcctgccagggttaccatggcgatgaggaattagtcccgactgccaaggctgctagcagctcggtacttctggctctggaacaagagtggacttatgtaattccgtgtttataggcctgggtggcggacgcagagctgggcctgagtctaggtggcggcccacagtgggtcataccaccccgcagggtatccctgacacgcctccggtgccctgatttttgggggacattaggacagaagcctggggcctggcaggctgctggtccccaccagggcctccccagccggggtgggagcccaagtctcgcgggaaggggtgcggctgtgctgtgtggggccgccccttgcccgcttggtctggagggaggatggccctgtcgctggccaagggctggcccctagacgcctgtgggtcgggcctcggaaacggggcatgctgacctgggctggcacactgccggccctcgcttgccgcgtgggacagttcctgcaagttgtgtggagcccactcaggctgttgctggtcatgctctggtaagaggagttgcctggccgggggcacccacatcccccgaccccagggatggtaccacagaccagaagactatgattagcaggatgtgggtagggggcaatgcccagggatcactggaattgcctgcaaggtgccccaagccttgcttgaggtgtggtagccctggctcctgtgagtccctgtcagccagctggggtggatggagaggcccaaggcaggacctctcagggtcctgtgcatgggacagtaggttatcttatcggggaaagttgttgatatcctatccggaagaggcactggttgctgcctggtggccctgggacgggatgtatggtacagatattgcgccctttcggaagcctgttggagcatgcctacccagttcatggtgggatagtagaacagttaggttgggacatggggtgactggatcagagtgtggggatgtgggcttttgggttggggggagccaggtgcaggcattgtgggcccagcctgcctccccactgaagtggagtttggctcagagccctgtctggtttgaaatgagggccaccggcccaggcttgcccagggccttggcagccagagaggggtagacatcggaaagttggaaaggcgtccggagctcacagcagcctgaggcagcaagcccagagcgggggatggggttctccaggcctggtgggggcagctgggatgcagttcccaagaagccccaagctcaggttgatgtgggggctccagaaggcacggcccatttgcctgtgaccctggctgttcattcaatccagtttcctgttctgtagctttcagtgtggcaccttaactatccgccttgcttccctgagtgtagagagaagtgacggggccgcacgggagtggaggtaataggaatagcattttttgagtaggctctggagcaggactcaagttagaggaccccggcaagccacttcctgttttggagtctcagtcttcccatctgacaagtgggcattttatcaagtcatgtggtttaaaggtgacaaagttctctggcccagggtgtgtttgtggtactaactagggttgtggttgctggtgagggtgacagtgacaacagtgggttcgtgccatcttggagtaacagtgttaatggagttgtggagggtcaaatggaaattcaaggggtgctctgagccttgtaggacgtatcaccttggtcaagccctagaactcctcaccctccaggtgtgccttgaaggagcagtaggagccccaggggctacagtgctgggtggtgttcaggggtagtaatctccccattcttgctttgtagagacttgaaccctgggctggcacaggccttcacctggcctcccctgcaagcctattgtcccatttcccctgagcctgggtctttgacactgcccagcatggcctgggggttgggctagggtgggagaccaatgttctgctgagggtggcaatggttttgtgtttgtaagcgaccccgaaggctgctgatactggctcagggcctctctcgtctggccagcagcagtcttctgggggttcctttctcaagccaccatgctggctgcccactgccagatttcctgggactccccagccttcaggaagggcccctgaagtggggcctgcacgtgcctctactgttctgaggcttcgtgtctgcttggggggagttgtctgagtagaggctgcctctgtcctgtgttgatgatgtccctgcttatgagaagcctgcatggaagcccagagcagggtcaggtatgggatggaggagctgtgtcagcagatggtcatcaagccttgtgtgcacatacgtgctcggatgcgtgcacacgtgtatgcctacacgctcatgttcacagcaagtatttgaaggtgtggttgggtcagtgtcctttccctggctgtgaccttgagaaactgagggcaccgagatcatggggacttgcagtggcatcccccaagaacagcctcacaagtttccttgtgccttgaaaaaaatgtgaaggcaggaccatggctcccaagaccaggctgtcctgagtttgtgccttgatgtgccttgcaggctgagcaaggtggcatccatctgtcagatggggtgagaggtcagcgctttgcagggctcgtatgactgttaggtcggtcagtagtcacctgaagcgagcacttgttaagaaggttttattacacttagtagggcaaggtggcacactcactcccttagtcccactactggggaggcagaggcaggtggttcaagaccagcctggtctatggagggagttccaggacagctgtggcgactcagagaaaccctgtctcgaaaaacaatggaaacgttttatcctgtcgttgttggggcgttagtgatgtacttccaccaatgctgtcggaggggtagaatttggggtgtcaggcttggttgtggaggacattacctacccgatcatcttgttggccataggctgagtgtgttcacgctgtaccctgccatcagatagtgtggtgggctgttgtggcccacctgttcgccagtgtgattgctttgatggcctcgctccgagtctggcacgatcgggtagttcaccttccatcccggtcggtgtgatttttctccgtttgtctgttaggtgtgcacaatctagttctcagaggttgcctcgtcactgtggcgtgttccgtcgttggcagtgtcttcatggttggcaggctttattgttggtgggatcaccatactttgcccgctctcttgttggcgtggtctccatggttcaccagtcccacaattggcatggcctttgaggtttgctagctacgtcgttggcgtggtctcagtggttcatctgctctgtcattggccttaggtgtgaacggtgtctctgaggagctgctggttctaggtgggattcctgagacttgtgcagagcccacacatggccaccccctaaaacgggtgcacttttgagcttgctactcttgatacccaggtggttctgtcttaggtagggtttctagtgctgtagtaaatcaccacaaccagtttggctcatatatccccaagtcaaaatccaggaacaaaggaggcaggaacctacaggcagggacttaaagcaggggtcatgaaggaacattgcttactggcttgctctaggtggctcacttactcagtctgctttcacgcacaactcaggatgaactaactgcctagtgtcggtactgcccaccatgggctgggccctctcaaatcagtcatgggtcaagaaaatgtcccacaatcttgtctctaggcaatgtcgatgggcatatttcctcagttgaggctccctcttcccaggtgacactaggttatgtcaagttgacactgtgaaccagagaattgcataggttacctgcaccccgcggggttgggaggggaattcagggctactctctgcgggattttctgccatctcctttatgacttctgtaaatgtgaccaaatgctgggtgagaagggggttagggaaggaagtaaggggttgtcttggctcacagtttaatgggttcagtccatcatggtggggaaactttgagacaagccggtcacatggcttacacagaaaacacagcagagaggaaccagtgcctaattgggttcaaacacccccccccccaatgaactacttcccccagccaggtcccatgccctaaaagctccagcgcctggggactgagtgtttagacacaggaaatgcttcctactcaaatctgggcagccatcctgtggagtgctgcaggcttgtttctgggtcctctacctccttgggcagaggttggagaggcgtgtgtcttgtgtagaggtctccagcttcctgagcttgtgggctgttgacacttggagaccccagatgaggtcctgtgtcagaacctttgaacttgcaccactggccttccctgagatgctctgcccctccttctccagtggccccttaattaggaggcttagatgtacctctgcacttggctggtcctgtgtgtgtgttttcctctgcatacataggctggtacttctgagcacagcctgccctcctcagttctgggagctgtctatccactatgaaggtgctaataggtgagggtcaggctgagtgccgaccagggcagggctgatctgttccagccgcaggcttacttggtggaggggttcaggcagccgcccacggatggcttctgtggcaaggacactggtccttcccatgacctcatcaccacccaaagtcttcgccctcctgatgccatcacttggtttataggtgtcagtataggtgcttggggcatgggtccccagatgtccatctgtgccctgataatttcctcggctgcacatctgcgcatagcctcttgggaattgtcacttggtgtctaagggcagtacgccaggcctgttactagactgagggggtcggcttagagtggtgtgtgtgcgtgtgtgtggtgtatgtagagtgtttgtggtgtatgtgtagaatatgtgtggtgtgtgtatggtgtatatgtagagtgtatgtgtgtatatatatattatatatgtggtgtgtggcatatgtatgtgtgtgaggtatgagtttgggtgtgtatatgtgtagggtgtgtgtatatatgtgtttgtatgatgcatgtatgaatgtatgtggtgtctgtgtctcttacggagagacaggatcctccttcttcagactggctgggccaatgacctgtggcactcactgtgggaaactaggacacactttgtttatgctgggttcccagctcctgggagaagtcatggggatggggttgggggtcaaggaaaggagagctctttgcttgaagtgtgggtttgccttggggggccatgagcattcattgacctcacttgagcccagaatcaacctgccctgtaaggctcagagagggttaagtagcgcgacgaagacacacagcaggcacaacacatgaagtggataaatagtttttgtgtctgtccgccttcagggtgatagtgcttaggggattatcctgcttcctccccagaaagccctgttcttatccttggctcagggtaggccctgagcagctctgggaggcccgagtcccaggcaaagctttctccctggctcagacacttcccaggccacccgccctgttctgaaagacagggggtggcttctcctgccacactgagccaagcattcagaagacccgccccctgcctccagtcgtgtttgacaatgcgccctttgtcccctggcccagcctcctcccagctcccagcatagtgccccctccccctccccctccttctcccccttcccgcctatgatgtcatggcaggccctttcagccaggtcccagacggatggccagtgtggacactagcaggctaggaacgactggcctgtctgttaccatgactggacttccctgaacccttcaaggtcagggttaatgtcccctcgttcgtgtgtgtgtgtgtgtgtgtgtgtgtgtgtgtgtgtgtgtgtgtgtgtgtgtgtttatcccatttacacagcaacacacaggtcccagctgagtccttggcttgcctttttctctcctctccctgaaccacttctagcctcttggcctgtgagtggacgagtcacagaactgatgtctcccaagagccttgggcatgagaccttggcttcctgccagtcagaggggctgctgggccaggactgtgcccctaggtgtccctgcatgtgtcgtcatgctctggcctttctggctatgtggggacactatagggcctagctgtgggtttgagggagcctcaggcgagattgggtttaattcagagcatgcaggggtctgtttaagtctgtacccagatcctgtgacagaattgagaaattaggtctccgtagggtgactgcagatagaatcaccgtgcatttgctgggtggccgtcatccctgtacagtgccatcataatcaggacagagtctcaggaaggaggcagaatggggcaacatgggcatagtaaggacacccggacttcctaaggatggaagagacttcctgcctgccctgggacgagcccatttggcctccatagctgtgacagaatccatttctgtgttttgaaggaccgcccttgtgtatagtaatttactaaagacttggcccggaaccccagtattgggagtaggctcacctgggctcaccacctgcctgctgtgtgacctcggacactttactcaacctctctgtacctctctctgcacctgtacagtgtttcagttgggatctcagggcaggctgtcaggtgactgggtaggatgccagcagagcttgatgagagtcagacacagggctggccaccaagatggcaggagcgttggtctgtcaccatggcgaccacttaggcccccgggatggcagcagcattgccctgtgggaagagtctcttcctccactgtgtgactagagctgttgcaggcacacaggtggagaataaaagcagagagacctggggaaacaacgcctgtaaggcttctcgcccaaccccaccaggggctgggtggtcctggaactctctatgtagaccatgccggtcttgaaagcacagagatccacctgcctctgcgtcctagcgctgggattaaagtgtgcgctaccacgcctggctaggtctctttctgtgttctagagaactgaactcccatcaaggtagaggaggggcatggtaaaggcaggtgtgtggcccattgtccagggtggcctgtttatcagctctgggctcctcgcccaaggccaggcatccctttgcagagaggccaccatgttcctacagaaccttcgtggaggcttcagtctcttccgggcagtggagtatgtctgctgccgagcactgacccagatctgcaagatctgtgaggagcaggcactgtctgcaagacccatgtgcctgttagagcaaccagtagtgaggacaggagtccgcatgcctgccttggctcccgccccagacgctcatttaaccacttcttccttgctccattctgtatgggagagggacctggaggctggacatctgagccaagggaacttagaagtgtctcaggatacaactggctcaggtctccccgtggcggtgggaggactctctgtcccttcttatgtttagtacaaaagttccggatgactagccagagcttcaggcccagctggatccaggcgcttggtctttctctttgaagtttgcacttaccagccccatgcgtgggggagagctcactgctcctgacatgcccacagggtcatcgaaggtgtacaataatgtcacacccacctgtgatcccagcatttggggagctgtgggcaggaggatcagaagttcaaggtcttcttcagctacatagtgaattgaggcctgcttcttggactcgggctaaccatagggcactgtgggtagctaccagggagtgtgctcaaaggaggctgggcccgatgcggtctgcctccacaggctgtagaaagaaccagcatagacctccaacaagcctgatgctgatcagttagtgtctatttggggtacatgaagcttatggctggatggctcactgggcaagggggtcagttacacaacctgtcaccagggcacggtcctagcatgagtgttttgcctgttgtaggcattgctagcgtgcggggtgctgtcagaggtttgcgaaactggctggctcagggcacagatgggtctgtcttggggtcccgtgtggcaggctggataactgagcagtcacctcttttgagagactacatcgagagatgcccccaagtggagctggctttctggctttgcctgggatatttgggctccacatgccctcccagccactttactgaattgcagcccagttcctggctctgtgttgttcataatcttgcctggcttgcgagccgtggtggcctggcagctcctcttctgtcttttgtctaggctctcttccctggatccttggtaatctggccctgtccactctggggtccacggtgggcaccctggaactgcctctggggtctggggtatctgggtacttactgcccttggctcctggctacagggcctcctgattttttttttccctttttttttttcaggagctggggactgaacccagggccttgcggttgctaggcaagcgctctaccactgagctaaatccccaaccccgggcctcctgattcttgaggggtgtctgatgtcagatctcttattgatcgttgcgagttactgggccgtcactagtgactgtgaatgtgctctgtctgtgccgatccacaggcggctactttggttgggatccaagtggccacagatttctctcctggccatcagggaagatcgggtagacagctcagggctggctgggccaggggactgcatcgcagggctccaataactgggcagttagtgaccagcagtctttggctgcagaggcacagccacgtgtggctgtctgctgttcccttcaggccatcagtaacctctcctggattcctccagaaggggacccacaggtagttcccgtggctaggcaggcaaatgtgtggttaggtgaacaggtgactaagcggggccctggcctgaattagaggttctgaaaagctcctcctagcctaggcccatggtgagctggtgggctgtagcccagcagatatgaagcattatgaggcccagctagcctcagggtttgtgggctgaggtgggtttgaggggggaccttttgctcattatgctgggtatggagtctctggggcctggagggagttgcatcaaggggcctcctggaggaggcatgagtgttcgtgcctgcatgtgcgtctgcccacattgtgataattacctcagtgttttgaattgcgtggcgtggatgtgttggatgcttccttttttttttttttggggttctttttttcggagctggggaccgaacctaggggcttgcgcttcctaggcaagcgctctaccactgagctaaatcccctaccccgttggatgctttcttagcgtgcggctgatctccagagctgatctccagagcctttgccctgtgaaattctgccccaagccccctcccccatgcccgtcaaccccctcttccctattctagcggacactgtttgtctctggccccctgctcatgtgtcacctgggctctgagtctctcttgtacaggagggagatgactactaagtctgactacccagcctgtaaggatgtgggttctcaggctgtccctgctgagagatgggcctgtgtctttccctagtggctttggtgatcttctctccgtcactgtaccaggaccttgagtaagcagagtgcttcagggccatgcagctggtgtcatgaccccttgcccctggcatctctatcccagccccttgtgattctttctgtctatgggcagagtggtcatggcgatggccagatggaggagagggattgatggaaacctgaggccacccagggtggctggggcatgaggaggaggagctggggagaacctgatgtggggaccggagaactgcatggccagggtgtcaccagctgtgctttagcctccccttcccccagctaaaagttaagtagtgggctggggagatgccttagtcagtcaagtgctcgccacgcatgcctgagagcctgagttctatccccagctgtgatagcttcctgggaggtagtgacaggctgagcatcagcctcggtcttctggtaattcccagtgagaggtcctgtctcaaaatacaggcggttgtgtcctgaggggtgatacccacatttgatctctggattctgtgtgtgcagacacacacaaacacacacgtaatagcaaaaaaataagcacaaagccataaggaagaagtgactccatctgctttggcaggagctagtggctggctgcagcccaggggacacccatgtggctaagtaccagaacccgtggcccacgcttcgtcagagtttttcagtcctaggtggccgtggcctgtggacattgtaggctctgggcagaggagcacccctctctgtgctgtggtttccccatctgttgaatggttcaggtgtgtttggtgtaaggcttggccagagaatacactgtggacagggcccatgatggggactcagctgctgcacgatagggggaggaccttgtgagggccacagggaagctagaggggttggagcctttccccggggacagtgcctttctagaggtaaaggccggcctgcaactcaatagcttccccgtgaagcctcctacctgaagcacagagaagtctgtacctagcccaagactgcacagcagggtaaggggtagagttagcctctggccttgttccagtcatttgggataatagcttatatggctctgttgaaaggggagctctctaggattgggtggctctcgttgccatcatttctacgcactgaccaagaacttgtgacttggcttcactctccattgctttgaccatgtacttgatcccagccaggggtggggctgtggaggaggagccctgtgcagtggggagatgatgtggggtacagggagcttttaaaattgtccccagtgcctaagtttggtcaggagcctcagaaacccttagagaaagcattgccagaggatagactctcatgtggcaatatggtgttcctggcaacttctggctcccacagaaacacaggagcagggaggcacatctgtcaggcaaagtgtgtggccagtgtggctcctgtccacaaggctttaggtatctgtgggaactggactataccatgtcctattgggatcccctgctcagggaacttggcagtctgggttctgaagcctgcacagagtccctgggccccatggtgggtatgagctctggcttctgactgccacgcacattctaattctgggacacctgctccccctcccccgcccccacaccttgtcacctcctgttctactataagtttgatagcagtgggtgctactttgccaggacgttgtaagctagtgctgcagacagtgtgtcccatggctgtcactccctcttccccattcttctatctcccttgtctaaactaggccactggctgtgtctcagagggccacacaactgcctgcagtcctgggaggaggttgctgtcatggggcggggcacaggtgggccctttatcagtggggctgcccgttttctgctggccacagtcctttgccgagtgtctgttaagctagccagcactgtgaggagaaggaatgggactggggcatacgtgtcacctgagatgtgtgatgcaccggccttggatgatgtgccagaggccgtaactgtagtaatgcacaccctgggttcagctaggccctgcccctgtagaacgacactgttccacagagatggtcttgttgagattgccacctgagagcctcttgccttccgggcttctcctttggcgctgcctagacaggttcttcctggcaggccgtgaagccaggaccctgctgtcaccaggctgcagccactccaccatgaggtgtgtgaagacggccctccctgtcacaagcttgcgaggcttctgtctggctcctacccgatgctctgccatctgctcacttcccttcccagttgccgtcgccccatcccacagtctgtctctagcttggacgtttatagtggttcgccagctgtgctacccgtggcaaaacacggacgctgtactgtccctttgtcaccttctgggactccccattgctcttggaacagaatctatttggattcaccatagtctgtggggccttgagtgacctccttccgtctaattcagtggtgttctcagacatagaacatctagtctcgcccctgggcttttgcctctctgcctggaacaccctgcctccttgttcacaacatgactgttacaaaacctgtcagtcgtgtccgcccttttcctttgtgacctgtgctgtgcccctcgtggacatttgtgtgagttggtcacacatacacaccgtgttgtcttaagtatctggctccttttgctcagcgtgacatccctggagtcatctagtgccgtctgttttgtttgtgttgttttttatctttttccttttggttgagaagcgctgtcattgaatgggcaggccacgctgcgggcgtttccgtcctgtgactgttgggaatggggtggttcttaacagcaggcaggtctgtgtgactcttgagttctttgagcttctaggagtgtgattgcagatcctcagtaattctgtgtttcaggtgttgaggacctagcagattgttttcctgatttgtatttgttttccaagctggcaccaaacacggctgagggtagaaatgtgaaaagtgggttgggttaaactcacaggggtgaggtcacctctgggggtggagtcccctctggtggggtggggtcccctctgggtgtgggggtcacccatggggttggggtcactcatggggttggggtcgttcatgggggtggggtcactcatggaggtgaggtcatagagtctaggctttagggccaccctgaatttggggacactggaaaggacttggtaggatgaccttggaccatgtagctcctgtgttcctagggggtgccctgtgaatcctggaccagccaggccgggctgaggtacaaggttccccagaggtggcttagggaggtgtcctctctgcctcccctccacttccactggccaagagggtagacattgtggacaacttccacctctcagccttcctgtgtatccccaaaatcaaatagtggttttgaagccctccacaggtatgcatagtgctggaccatgcgacccaggttagtcaaccttggggtggggtttgcattgatggtgctgtgggctggaggtgtggcggaggcctgtttagcccagcccctcccaaggcagccgcttacctcaggcccaggacagttgccatgttggcctccacactctgtgttcctaagtgtcatgtgacgtgtctcattttggtgcgaggtagtctttgtgagtgagacttcttggtagcaagtaacagcgtcagccagggctgtcagagcaaagccatgcctgcccagagggctcagggatggggggtccactgggtttccaggctgagctatcggcttattatccctttctttcggccacagactcactgtggttggggatggcgtccatgtagctggtgtggagaatactcgggcttactgcaagctgggggcttggcgtgcactagcgctgggtgtgagctcacactttacctgggctctggggattcaggaggcaacactgcggcagagagcttctcgtttacaattagtaataaaaaaaaaatcattttattttaagttgggaatttcacccgggacctcacatatgctgggcaagtgctgttactgagccacgccctcaccgggccgcattgaggattgtaggcagagtactgccactgagctgtatccagcccttttcatcccttcctcccttcctccctcccttcttctctcccctcccctcccccctccctcttcttttttccccaagacaggctttctctgtgtagccctggctgtcctagaactcacaactcactttgtaggccaggcaagcctggaactcagagatcctcctgcccctgcctccccagtgctggggttaaaggtgagttcctccaagcctggctcctttttgctttttgaggtagggtgtgacttagtttctccagctgcctttgaatttgcactcctcctgcttcagcctgctaagacggatgaacaggtccatgcaccgtgctcggctgtgttgtcttctgacccttctgctttgtgtgctactgggtctccatgtgccagagtttggcattgctgccacactgaaggaaagggactgactttgaggaacgtctccaaggtgtgacttgggaggaggggtgtgtgtatgtgtgtatgtgtgtgtgtgtgtgtgtgtgtgtgtgtgtgtgtgtgtgtgtatgtctgtctgtgtgcgcgcatacgcatatacacaggcaaatttaggaagtaccttacattggtgacatctcattgaccctgaggggtagggacagtgccacctacactttggaaattcgagagctgagattctgagaaaggactgcactccctgaagccgtggctcttggcatggttcttggttcagtgttcttgtgttcataagtgtcatgtgatacgtctctttggtgataggtcctgtgcgagccagagtttatggtaacaaagtcgagccagggccatcggagcaaagccacgcctacccagggtgctcagggatggctgtccactgggtttgcaacatgacttacctgttcatcctttagccagtcaccgccttcctgttctgaccatctgatttgccatgcccaggtcacatgactcttcttggggcctgggttggaatgtcaggtgcacactggtagcttgggaagggggtaggaaggtcagtggctttttggacttgcaatcttctccctccatgtttcatctccctgcatgaaacctgacactggataacacaggccatctgttgttagcagttagcccaagaggaagggccaggctgaaattacagggagctaggggtctggtcggtctcctcctcatcctcttgtgtcatcgcttgggatacagcccagcctcggctctgggtgcaatgtggaagagagggccttagggaaagagaaggaccggaccacggggctgtctcagactttccactgtgacctctggctcctgcagttctctctgttcccatcctcgagagcactgcattgtggctcttcttgtgttagccatggaggttcctgcctggaaggtggcctttctccatcctggacctgtttgttgcccgcctgtccaggatgcttgtgtctggtcctgtctgtccctagtgtgaccctcagcatcctgtttcccgacccccagtggcaccaggccaatctctcatcatttttttttttttttttttgttctttttttcggagctggggaccgaacccagggccgtgcacttcttaggcaagcactctaccactgagctaaatccccaaccccggcaccaggccaatctcatctgtgtcctttccacatcctgaatcagtctctggctgaggaggagccaagcagccttgcttagcaactgtgtcaccccgtggcccttcgtgggtcactgccgtgtaccgttcttgctagcacacagcccagggacaggcccagcagctgtgagctggagctgccaggggcttttgaagaactttgtcctggagatctggaaagtcccaactgtggcacgaactggctgcccaaggtgggtgtgggagccgtctgatggctgtcggatggctgtgggtatggtatccacacggaggctcccaagtctgctgaggcctgtcgagtagggagatggcttgtggagggtaggcaaggtgttggtggctttgtgctgtccttggagaggaggctcaggcaggagaaaaggactaggccgcagtagccagggaccagctgcctcctgttcaatttgttttctttctctttccacaggtacctgtgacgaggtcaccggccagcagatgaccgagaccagcccctagtcctaggtgtggtcaagagtgtattgggttccaaagccttcctggaccctaccaccatgtcaggatccacacagcctgtggcacagacatggcgggctgctgagccccgctacccaccccatggcatctcctacccggtgcagatagcccggccccacacggtaaggggcatatctgctcagtaccacccctgctgcaaaatgcatcttctgaaggcagccgctgcggcgcggcctaggttgatttggtctcagtggggagactggtggcagccagctgtggtgatggaggtctgcaatctcggttgtggaggtgaaggcaggaggatttccattttgagaccagcctaggctacatagcaagtcttgttttagtgtgggaaggcggaagctgaggctaggctgagtggacactgcttatatctcgatggacagtgggcttggcgtgcacgatagagcacccgtggtgtacattcccctcacagcgggacccatttctgctgtgtttgggactggggtggttttggacagggagactgaggtcgcacttcttcctaaccctcaagaccttggtgcctatttagctgtaagactctgaagcccagagcagcgtcggcctcggccagggtcctgttcctcctgttctcttcgtactgtagagcctttgagtcatctgtgtcggctttcgttgtgggcctgttgtataccatgtctctggctgttgagtgaaggggtgtgatgtgagatgtagcagtcacagctaggagggagtccccgtgtgtgtgtgtgtgtgtgtgtgtgtgtgtgtgtgtgtgtgtgtgtgtgagagagagagagagagagagagagagaatgagaatgtgtgtgtatctatgctcgtgcctgcccctcctggatggtgtggtccatttctgtaacagagctatatttgtgtgggatgtggtttttacttgtgagtcaagaatgctttcccatgagccccagagcccaatgcatagtggctcccccagaactgagaacctatgtgcagagccagctgtactctcagagtggcaggtccttgaatggagcagctggggcctagagggagaagacaagccctaatcatcgtcctgggttggggtcctgtacgccctagctcccggccttatacctccactccgaccatttattcgctggatgaggcactgggtcacaactaagctagcagcaaggccagctgctctctaggctggcgaacgattccagacgctccatttaaggttgggggctctcagttccatcacctataaagcaggggtgatgacaacacccacaggaatgccaatgcatgcccccatgtggctgtccactgccaccataacttgatactgttaaagccatttcctggatgggccctgtctggggttcgactatctctttcccctgcggactcccctccccccatcccagccccccaggcagatgtccatggcttcttccttctccttcattcacactgctcatccggctgctgcggccccttccttcatacctgacttcttgctctttgccccacttgtgccctctccccagcatttagggtcactggctgaccctaggcacctcccactctcctgctgtgctgttggtgacacaggcaggatgccgctggaccggacccagtggttactaacccccctggggtgagtgtgacctaatgggatagcttacaggtcggaacatgtctgtctcctagtggggcccacgggttccgttccaggggacctgcttgctcttcggcctccagcccttgctgggccaccaagcagggctctgctgatgcccagggactgtggaaggtttttctctgggtggatattgaggcctcatgacttttctgtgctggcttggtgaagtcaatccccatctcccactgtaccccatctctttcctgtggctcaagtctgggtatcgcagacgggaaaagatcctacactttccctcttaatgctgtgtcttaggaaagagagggcagagaagagaagccatgaggcctgtaggggagatcacagcatctcagggagccaccgtggttctagccctggtgtagtgaccagctcagtgtgtggtgtcctgggcctgggtatgcatgatgtgtgccactcacacactctagcaggcctatcttcgaggaagctctgcgctctcagtcaagtgaactgcttataaaacggctggggttctaccaaggtgacgccatgcttgggctatgagcgggtctctgtgtgatgtgacagtgggcaccccctgcctacagcatcagactgttagtcccctcgtgtcatcgggaataacatgcttcctgtgagcgtcaggcttccttgtcacaccctatagtttgtccctttccctgtctccatgctgctggcagtggggcgcaagagccatgtatctgcaggtcagtgccgggcaaggtgtgtgccagggacgcctgacaaagttgactgtctctagccttggccttgggcctagctggctgactcttggctgtgggatggacctgcgggctgttgtccagttatttacaaactgctatgccacatggggctcaggctgctcctgtctaatggcactgggtgctggctggggctgacgtcctgggtgtgtgggcacatcgtgggttcctgcaccacctgcacatgtcacttgttactgcctcagggccctcatttgtctgtccattcatttactcactctctcggtcattggcctgtcggttcgttcttcactcattaatggattcactcgttcatttgttggacaaatgcagattaggtttgtcacaggccaatttccaagccttggggacagagctgtgaaggcctgagaaaccctctcactctggggagctgacattctcttggggaacagtgagcaaaggcgaggctggaggaggccatgttttaagtggtgagcctaatgtcgttggtggagctgggacgggagaggagggacaggcgatgcatggcgtctgggtgggcagtgccccaggctgcgtggaagccctgaggtgaggctccgttggaatgaacacaccactcaggagtgacctgtgaatccagggttcacagggctcggctgaactctgtctccatatgacctcgtgtgcgtctctacttcttagacttgtgctggggtacagtgtgtttcttggggctccccacttgttctgtttgtagtggaaatatccggggggtggggtgggcctctactcttgagtcgggtgttgtgatcagccactgggcaggttgtgacctgtgacctgtgactgtccccgttccctgcggaggtgccagtcgagcctcaccctgtagaacctgtgctgtccttgctgtgcgaccgggaagaaccgttcttgcttctgggcccctcattctcttgttgttcacaccacccatgatatcctccttgtgtttgggggggtcgcattagacagctcgtgcagaaggcttggttgcagcgatctgagtatgggatcccttctctccaagtcctccttggcagggtcatcctggtagccttgtccttctcctgggtcttgttttgcagggtcttgatcttcccttgctgtttggtctctgaggtttcccagttgctcatcctctaggggcaggagcctggctgcttctatagcctcagcacacttagctgctatcattgattctttgcagtaagaactgtttaagacacaaagccagggcctcaaaagggcctgagctgcttttcaggggatctgagcatggttttacgcatccatgttgagcaattcatagctgcttctaactccaggatatccaatgtcttcaggttctctctggcttaggtgggcactggactccagtgcataggcacatagacatacacacagatacatagagataaaatgaaatctaaaacaaaataaaaaggaccgaaaaggagaaaatatgccaatggaaaactaagttaacctatagttctatagttcacgctatctgcggctatacccgagacagacattactaatcgattgccgtgcatgtaatcaagtgtctaggctgatagactagattgattggcctggtggtcttttttttttttttaaatggtgtgcacactcagctctctcctctctcaattccctcattttcttaccgtgataaggtgatcttgacccttgtgaaaaatgtaggggttggtagaacgctagtgagcagggagggagcctggcaccacgatgagacttcaaggttgggggactttgtcaactgtgttgactccccagcactctttctgcaagggtaggctaagattgaggcctccttcacagacctcaacaccaggtgtggtctgaccagcgaaatcacaatcactgttcaaagcgggagggtgtagcctccctccccccatcccccacacttcataagctagctgtttttctcgtggtgggcgggactcctgaacagctgcttggctgggatctgggtttatatatctccatctgtcctggctacgcaatcttcctctctctttcgtgttttgagcttgactcttcacagggatacctgtccgaggagacctgggtctccattgaaggcagatacatttctgccctgtgggccgctccatgctcaccagtgccctgctaaggcaatacccagccccatgtcagtaggcagggcctgggagaagtgacacattgttctctaaacctgcagctcactggtatgggcagtgggatttacaggctgaccgttgtccagcccgtggccttagaggacctgtgctttgccctcgtccccctcagatgtaccagctagagagtgggacgatacagggataccacatacatgccccagtgtggcctgtgtggggatgtagagtccagtactaaggttattatgatcttctacagtaaggggtacccccagctgtaccttgtggctccagggctctaagcatggtgggaaacatcgctgtggcaattgtagctagaggatgtaggctggaaactcatctgggcctcttggtggcaaggaagctgccattgctcctgtgcttgctcactgctccctttcttccacaggacgtggggctgcttgagtaccaacaccaccctcgtgactacacctcacacctgtcacccggctccattatccagccacagaggaggcggccctcactgctatctgagttccagcctggaagtgaacggtgaggagatgttgccgccacattttgtctaggctatggtgtctctcaggtagataatgatagtttttgtaggtaaagctgcaggggtccagacttcagcccttcccagcaccacttcctcctggtggcatcctagggccatgacagggctgtactctcccaggagcaggggctgaggacttataggtagaggaggtatgaccatctatctacccaaggttaaggaaaattaagaggcaaaaggctcacatctttctgcctgctggctagatcagtttttaatagcagaagtgctgtgatcggctagtgatgtctgcccagggagggttagaaggaaaagtgttgtgtatgctgttctttgcgtaaaccttatggtgcttctcaggcctgtgctttaaaacccccaggggcttgttaaaatgtagtcttggtcagtagcagtggtttaggttttacgttttgcatttctggttagctcaagagggtctgtggggttttcaggctgggtagtcacaacaagtcctcatgagtcagaactatgtcctctcctatcagggaagacagaggaaccttctaacaagtctcctcatgagaacccggctaggcagacacccagattcttggtcctaagcttctgtctcctgtgtaatgtgtgtccctggcctcccacaggtctcaggagctccacctgcgccctgagtctcgcaccttcctgcctgaactgggcaagcccgacatagaattcacagagagcaagcgcccacgcctggagctactacctgataccctgctgcgcccggcacccctgctggccactgggcagccaagtgggtctgaagatcttaccaaggtacaccccagccaggcctataggcttgtcagctgctgccactgctggtgtgggcaggcaaggggctggggctgggggcaggcaaggggctggggctggggacagggaaagaaaagctgggtggaaggatggaggccagctctggtgtgggtgtgaggatgggacggagcactggagccaccgccaggtgaggagagagggcgtgggtgatggaaagaattgggaaggtatctcgagctggcaggagcatacagaccctgtggtgggacccggtgtgtggctgtagtcacaccctggtgtgactgggaagtgtggagtgagggttctgcaaagccttggatcagaaggttggagactgatgggacaagatcagcccccgtgaccatgttagcacagtctgtgtgccccgtgggggctgggctgcataggtgacagcttgtgtggaacaatggcttgggactcctcaggcttcatgtaggagccagagctggcccatgtttgggactctggagtccctagagatgagatatgatgggtgggatagtgtctggcatgtcagggcctggagttgagggcctcaggcagacagacctacggacagacctgctgcagcccaggtctaaatggctccttgggtgccagatgggcgggatgggtctacatctgtagccatgtgggcttgaggatccgcagagcagcgggtggccaagccctgtccccagggaggctgtccacaagggagcttaattccatgggttcccacaccctggtgttagaggaggaactctgggccttgtccatgctagactagccctctaccaccaagccgtatctttaaatctcttttaatgtatatatgtatacatacatacatacatacatacacacacacatgcatgtatgtatacatatattacttttccaaatatggtctagctaaatcgatcagccagccttgaatgtactctgtagcctgcctgggcaggccttgaaatcataactttgcctaagccttgcatatattcggcacagctccgatgacaggcctgttaccctgaggcaggcttactctaagccttctgtctgttctccagttctgactctgttccagctgtgctgctcaggctcgggcctctctgagccctgcttgttctgtgttagtagtagaccaactgacctgaagtgacccaggctatctggatagggggtttggctgtgagccttgcacgcacgcacaccttcaggctcgaccaggtgacagaatcagactccagtctccatggggagtaaagacgctggcatggcttctggaatgttcttggcgggttagagctataggagtccagcccattcccagtgtggtctgttcagctgctgtgacctctgtcaggtaattgaaggcaggtgtcaggatgtcaggggatacatggccttgcttccctgacactgattggggtatcctcattccctgccccagaccatccccgggagaggtcagttccagacggacacttcaccccctctggcagctctctctcctctgctgctccagtctcctgcccctttctcatctacctacttagcccatgatcccgcacccatatcctgccatggagatgccgggtctagccactgcctaccctatgtcagccccagttgccccagatcactgtcactcacctggactgtggcagtggcctctcatcttccctccctccgttccttcaccactgggtcatgtgggggcaggcaaggtcttgcctccgtctcaaacctccttttctcaggtatgaaggtctagatccctttcaagtgcttggttattaggtccggtgtgaccgagcactgatgtcatctctccataccctgtgtatctttgtgacttcttaaacctggcctggcccctccctaggccctggcactgctggtgtgcacctggttgccctctgttccctcagaggctttctggactgaaggcagtgggtacccaaggctgtctgggagcccctggtgggatggcctgaagtcttggcagggaactctgctgaccacactgggtctggacttgggacaggtggcctctgggctgtcctcctgcactgctgggtgacctgcttcctctgtcttctcttctccagcatcaagtgtttgaccccctttgccctgtgctcatccctctttccctctcctgccacccctctgcttgatcttcttccagctccattatctttgtccctttgtccccaccccttcccccagctgcccattctggtcaccatccagcttccctgctctgttgtcatatatctccccacagctgcccgatccatccttcctcatctgtttgtttgtctatctatccgtttgtactgtctgtctatcccccaccccactcctgggtcctgtgaccggtgcacaggatggccattcatttcttgggtggccggggacaactctctctgtgtgttgagtctaggcgcctgccatgccttcagtgctgtcaggaatctgagtgtgatgtctgatcacggtatggggacagggactaggcttgagatggggagtgcccactcaggacagtggggtggggttttccccatgcctgtactgcaagtggatgagtcaagcatccccaggccaggtgggggccactacagggtggccagcaatgaggaggcataaccaggaaggccacaggatgataggctaataccaagtgtgcgcctgcagagtctgtcacatgcccaaggtcttcccagcactgtggcgccaacctgggatgtccctgtttggagcttgggctgagagctaaaagtgggggatatggggttcaggtaggcaactccttcaggagactcttccttgccctagttcctcagttatccctgaggccctctccctgctttgtagaaggcaggaggggctgtgcatggtgagtcttcatcaaggggtagcagatgattgtctcaggaccagctctggtctgggttttgtatccccataggaacctgtcagcctctgctgtcactagctgcttgccagagtgtcccagttctatttagcctgtggcttttctgatggttttgcctcatattcaccagtgaggccacctgtggctcacaccggtggctcaggtgttcctggcaccctgtctcaatcaggggttgccatcaaaagcaacttggggaggaaagggtttatttggtattcagatccacatcactgttcattaaggaaggaagtcaggacaggaactcaagcagggcaggccatggatgagtgccactttctgacttgctcagttcttacagagctgaggagcaccagcccaggggtggtgccacccataatgggctgggtcctcacctatcaatcactaaggaagtgttatacacgcaggcttgcccacaccttgatcttatggaggcattttctccatcgaggtgtcttcttctcagatgactgtagcttaagttgataataaaattagccagcccaaccgatcccttgtccacttgacacaaacacatcactgttaagccacagcctttcctcccttgttcttccctaagacgacacattaataaagacatcacagtagaaaagtttacaagctgaaaaaaccttacagattcaaaccctaaaagttgtcttcttaaaaatgtcagtcttaaagtcccaaatctctatagaactctcaaatttctttctttctttcaagtttaaagtctctcaaccatgggctcctataaaatcacaaatgagttaaacacttccttacctcaagagggaagaaccaggggacagtcacagtcggaagaaaaaccaaactcgcagtgtaaatcagtgtggggtgcgctcgtgatctctgggctctagagggctggccgtctaggttctgttggtgttcttggtggtcatcctatagtacctagcatttccaaaacactggggtcttctgctgcaaccgggctacactttcaccaatagcttctcttgggctctctttgtggtgccaagtctgtttcttagcatgaccgtttctgggccttccaactgcagcaacttcaccgatagcctctcctcacctctcacaacgcacaatcccagtttcctgccttcacgaccacttcatgtctttaaaaccaacacttcctgggtgactctttaccaagtttgacttgagggcaaggtatgacgctggctgcctctggaccatagcctcagtgtgctggctgtcaggaaaggcttcttagaagatctcacctcagtgatgcaggtttgttcttaatccctgctgatgtctttcacctccagccaaccagcatccattgtcccagtaaagcaaaggttttacttcagaggcgccggtctcattaaatcatggctgactcttcagtcccagctaaagagaccagacaccacagtcttaattcaaaataggaaatatgcaactggcctggtagacttaatgtagctctcagaattccctcgggaactccaccagccaggcctctgtcatttctgatcctctcaacattgttttctgccacgtttccgtagaataactcactggactttaaacactcggtggcttttcttgtccaaaattctgaaatcctttcaaaaatcctccccaaaacaatacggtcaggcctgtcccagcaccatctcagtattctggtacccatatctgtcataggtagggttacttgtgctgtgacgaaccaccaggaccagagtaacttgaggaaagagtttatttggcttacacgtccaatcactgttcatcattgaaagagtccggacaggaacagagcaggaagctggaggcaggagccaatgcagaggccatggaggggggctgctcactgacttgctccccatggctttcgaaacctgcttgcttatggaacccgggaccagcagcccagggaaggccccgccacaaatgaactagacactctctcccgtcagtccccaagtaagaaaatgctctacacacttgccggcagcctgatcctagggaggcttttcctcagtcaaggtttgttcctcagatgactacaacttgcctcaagttgacagaaaactagccagcacacacatctttagggtcgctgccttgttttctctgtttctcgttttgtttctgcttgatcgtgcggttctgtttctgaccgtctgtcccccactgtctctgcctctcgccttcccaccatctgtccctctttcccctgcctgggccccgtctgggctggagccaggctccggggggactgggtgggtgaggagagaatgtacacagctctgagcaactgtggtttgtggggggggagtccagctggaggcaggagcaggggttttggggggagtttctggccccctcacatttggcagtgccttcgctgtccattgagctttgttttgggggactttggtatgtcgctgaggaaccttctctccaaggtccttgggtggttggggcctgggaccccagcttaagcacagatcctgaactcaggcgtctctcatgaaattcaggtttgatagcttctggctgagctcagccctggtggctgacatcaccgtggcccacgctgcttcttggagtgcttgaaagacagcatgtgtgactctgggcaccccaatccttacccctgcacaggtccaagacccacagagagcaagttccccatctctggccctcccgatccagacccctctgctgttccccttgctctggctggagcctgtcgcttggctgtgggccacaggcctctggtggaacgggaagtgattagcctcaggttcccattcccaggccttctgtgacaggtctttatgtcagaaatagacagtcttacgctgccttgaagctttctgcctagtcagagaactgcagagagtgactgactcagtggagtctgactgactagtcggctggagtgagtctatctgactgacgggtggacagatggacaggcgggtggacaggcagatggacggatgcgtatctcactggctaagagagtctggggagggactggtctatggttgggcttagggttcatctgtcttcaggctttggggcttacagaggggtcacctgcaagcagagccgcctgccacttcgaggctagcctgtcagatgccaagcaccgtctctccaccattggcttacctcgccgcctgtgaaggcagtagcaggatggtctggagtcagggtgtcagcccctggaaagtttctccatctatgagggagccatatgtatggcttcccccggcctgcagtctgttgtggtgggtggatgctctctgtctgggtgttccatggcctttgttcttgtgccttgttacgtgggagcatgtgtatctatctgaaagggaacctgctgtgtggaggagtctgggttgggtcatcttatgcctggtcccaagggtgaaccgccatgaaagtcagcctgatctagctggtccaggaagtggggcttagccacacggagtggctggtgtggccagctgcagtttctgtgctgtcctagacttggggacggagccttctttaggtggcatggctttggggcccagggtggactgtttggtccatagtttcaggttgcctggtcccacaggctaacagtctgtctctctcttctgcttttggggaacatagcagagggaagcgatatgaactctgggccaagaggactgtcctaggtgccaccttcggttttgagatgggtattgagagcttcctggagaattctgttgggaggagagcctgaagtccccagtgtgctgtgttcctttgtccttatattttaaatgacaacatgaggctgggggcaaagtccagggctgagagccgacagaggtagggaaggggacagcaaaggggacgaatgggagttgtagtctcttcccatcgcaagggtaatgggggagggagtaggtggggcacctggctgcccaggctacagttgttcccaggaataaagcatcctgtgtccttagagtgcagctgtgtgggggcggggagcagcccgactctgcctggccacttctgccagcagctgctgtcttggcccagagggagacagggtggggctgacctagctgggagccagggtagggacagacctttcttgactgcactattcagtgataacagtgtgtcagacagactctttgcatgcaccgaggctcacaagccactgtggaggtgaaactactcctgtgtctctcccccgttgtacagatagggatactgaggctgacggcacctccatgcaccatctgtggtcacagaactgggtattgcagagcagggctgggatcgaagcccagggccatctagatgagaactgggttgttttcctaacctctttgttcccggagcatccctgtgcagcctgggtggtccctgactggccagagaacagagggaactgtggagcagccaggtgcagggccatgcgggagacaaatgggcagcctcagggaagagcagccaccgaagctgacaaatgcccatcagtgagaaggaaccatgtgtggtggtgcagaactgacatccccgtatgtgggaggcggaggcaggaggatcagaagttcaaggacaccctgggcagcgtagggagagatggctcacgctaggatcactgtggagatctggttcccagtatccacatggcttacaactgtcttaaccccagttccaggggttctgaccccttcttttgacctctaaagggaccaggcatgcatgtggtgccagatacatgtgtgtaggcaaaacactcataaaataagtccttaaaaggttgaaggtaacagatggcctgggcagtaggtctgtggtcgagcgctcgcttagcgtgcataaagatttcatcgcttcgctctgcaaaaacagaacaaaaacgaggcccggtgaccccactggcttctgtgtgttgtgacaggtgtgctttctgaaaagctgactgctctccttcagggcctgcagcctgcttccctaagctatcctgcacatgtggagggcacatgtggctgcactgggggcccggggtcactgtgggagccttatttctgtttccagggaataggagagatgtagccaggaggaggcagtaagggctgtcaatactcaggccgcctggaattttgtcttctaagaacacagccatgggaaagagtggccagggccaggcaggatccacatgtagcactgtgactgtgggagtgctcagggtaggaagttcgtatactgcggcctgaagtcatggctggaaaacaagtgcccagctaacttgggtgaccacactctctctgctctgttcatccccaggaccgcagcctggcaggcaagctggagcccgtgtcacctcccagcccaccacacgctgaccctgagctagagctgacgccatctcggctgtccaaggaggagctgatccagaacatggaccgtgtggaccgtgagatcaccatggtggagcagcagatctccaagctgaagaagaagcaggtgagtagtgaggatgggaggggctccagtgagcgggcaggaaccccgccccgaatcctccggtgcccgggaccatgcagtctcctgttttttaaatacgttttgcttctggaagcctctgggctgggcacatcagggccatgcatctgtacttccaacagagagtccagagtgttgggggaccaaggctttctgagcgaggcactgagctgcctgggacagagaaagagccataggctgtttttgcatgagaagctgaatggggagctggaagctggacagtggggcttccaagatggcgacccaaaatcccagagtgaggctgggccctggtgccgttaggttggccatgccagaccagtggagaacatcttcggtcctccaggcctggcttggggactgggctggagccacggttacattcatggatgttgattaattccggagaccaagtgacttgagctgttgttattagttttggtttgctttttttttcttcttctttcttatcctaaattgcttttggaatggtatcttataaaagaatgtttttatatacgtacacatgcacgcacgcgctcaaacgcccgcccgcacgcacggttaaagagatgattcggtggttaagggcacgtgttattcttgcagagtaccaaggttcaattcccagcacccacatctggcagcttacaactgcttgtaactccagctccaggagatgcccctgacctcaggcacatgggcatatacagacgtacacacacaagtacatgatgtaaatgcataaaaaaatattttaagaaaataaaaatatacttagtcatttgtgtgtgtgcatgtgtacgctagaatacagtttgtgggagttggttctctccatcttgtgcttgtcagcttgtggtgagttaacctctccccctacccccttctttttttgaggcagggtttctctgtgtagccctggttgtcctggcactcaactctgtagaccaggctggctttgaagtcacaaagatctgcctgcctccgcctcctgagttgtgggactaaaaatgtgtgttgttcctacattggtcagcaccccttcttttagaaggggacatggaggaagacagggtctttcaggccctggttggcctgaaactcactagcaggctggcttcgaactcacagagattgcttctgaccttcgtttgagttgagtgctgggattaaaggaagcaccaccatgcctgccccacccacttacatttataagtgctgcgcgtgcgtgcgtgtgtgtgtgtgcgtgcgttcgttcaggtacctcgaggccctaagagggctttagacatcttggagctagacttacaggtggttgtgagctgagttcagtgctgagaactgaactcagggcctttgcaagagcaatacacactgataaccactgaccagtctctctgtacataccccttggccccaaactaaaattcccaagcataaatgaatcattttaaagtttacagttaactggcaatgggctctctcttcctcctttgttctgacagacgcagagccatttagcaatatcccatcttccagcccagtgttcccgctgtgacagtctgtggtgctactttctggatctcacacacacacacacacacacacacacacacacacacacacacacacacacacacacacacatttgcctttcgtgtccctgccttgtgcgctcagcataaggagtttcgggttcacagagcgtggttgagcctctttatggaagagtgctggtctaccgtgtggctatagcttgaatgactgtttctgcttgtccggcagctcgcccgctcactgctcatgagggcttcagttcttccaggtcctcactggtggtgtttccagactgtactggcctgggactgtgtagtgtgtgatcaagggcggggtgaagccagggtcctcacagccctgcgctcaccgggttgtgcggtgtctttttagatcttccaatcacttttatgggtatgtgatgtcactgccaggtcacactgaggaggtggccgagggtcagagaggtgcagtgactctgggaccctgagggagggaaagtctgacttcaggccaagagctatgctgtctagtcagggcagtagccattggttcgttctccgggggagggtcttcaccctcccagcttcttagtgttcctggcttttgtttctttgtttttgttttggttttttttggctggtctgtgagagctgccaccaggggtcactgcaggaccaaggccctcaatgctgcctgtttctgcctcatcttatccctgtttggggccgtgagaatctgctcccatgtgactgaacatgctagctgtatgtccatagtcagcagagcactcatggcgccctctgcaggtcaccgtgggcattggcttcccgtggagcctgagccgagtcttgaatcctttggtcttcgcttctgactttggggtaaagcggacaccagcagcagcagcaggaagggatgccacatatgaggaaatggaccaggggtccagtgtgaacacatgggcatgtgctgccaccgcggctaccggtggtggtggtggtagtgagagtgatgatagtgatgttggtgatggtgatcgttgagatggtaaaatctatgtgacggtgatggagttggtgaggatggtgatggaggtggtgatgggcatgagggtggtggtgatagggatgagggtggtggtgaggatgctgatgatgctgatagatctgatggtgatggaggtggtggaagtggtgattggtgatgaggatggtggtggggtgagggtggtgttttaaggatgccgctgatagtaatggtggggatgatgttgatgattcgtgtccgtggtggtagggtggcaatggtggtggcggcagcggtgttcatgatggtggtgttcatgatagtaatgacggtgatgggtggtggtgacactgttggtggccatggtggccggtggtatcgatcctgatggtggcgattatgcactgctgttgtggatgtggtgctggcggtgatgggtgtagctgtgataatggcgatggtgatggggttgatcgtggtgaacgtgatgctgaaggtgattgtaattcgatgctggtggtggtagtgtgctggaaagctctgtctggcgagcctttctgcctctcccatctccctccacgtagctcctggtttagtcctcagtagatttaggaactcttcgtttccaggggaggaataggaaggtcagagacaccgagtaacgtctcaacaggctgtgttgttgtccaggtcagaagtatcatgctccaggttgaggcctttgccctgtgcctgcagcctctctgggagccgtgagcttgtggcggcagtggtgggtgagaatggccggtcccttgcacacgtagtgcagtccctcatctgtgtgacctctagcccttattacagcccagtcagctccttcgcacagatgagaactgaggccctagcaaggaagaacccctcttcccctcctgctctgtctctggagcaggatttgaaccaagaaagcctggtccaaggtggatacgcaaccaccagggagccctgccaaggagggcacaagtgtctgggtgactcataggaaatggggatcagcctgacttcctgtgtgtggctacgggcaagcggggagcagcgcctcagcttccggcctacaccgctcacgctgtcccttccctgcagcaacagttggaggaggaggccgccaagccacccgagcccgagaagccggtgtcgccaccacccatagaatcaaagcaccgcagtctggtccagatcatctacgacgagaaccgggtatggcctgcaggaacaaaccaccttgaaccacgagtccctgccacagtggaggctggcgagtgggtggggagggcctgtgagccatgcatggcataggcgtcaggctggaggggagcgagggggcctgctgttctctgagaggcaccatcacctcgtatctgcacagcagatccagtggcacacttggttttacctatattaacactgccagctagctcctggcccgccctaggaagatgtgcaatggtgtctccatcatacgcatggagaaacagatccagggatggggcgtgccgaggtcacagttacccagccaggatgtggtagatgtgggaatttgaagtgggctcatgagttgcaggacctgattctcagcctttacctctgcttccacagtccccctcaagcttgtgagctgggacagccaggcacctggtaggcgggagggaagttcccctttctcccctctcattggctgattccacgaggacctttgagcttctgagccttgactgcttggattctctgtatctgagagtgagaaaccaaagcccagagagccaaggcttgtgcctcagctccttagcaggctacttagcttaagtaggtgttctttactgctgaggaagagactggggttcagggagggcagggggcctgcctgagattgcacagcacgttagatttggggctgggactcagaaccaagattaaacttgcttgactgtggtggaggtggtcggagaagtgtgattctctctagctgcagtggacacatgttcccaaggctgccttccggccaccctgtgttcagctgtccttctttaagggaggtgcctctgctctttccctctagccccgaaccccaccccatcccccacatttgtactggctaaggcgtgtatcacagccagttatagtaggtgcttggagttggcaggagacccggagatgtgtagcacccttgtttgtccctctgcctgcactgagcctggagctggctacccggctttccttgaggagtgacaggcctagtgttccctgccctcaataggactcgattttaatccccttccttcccgccaagaggcaggacaagggcttgtctccattgttcctgtcctggtcgtcaggctgcccaaggccttgtgcatctggaacacatctgtcctcaaggccagcgagtggctttcccacctcccgtggagtccgtgggcatcaccgttgtgggcgcagctgaggagaagtgtgtcacagtcagggagggaagggagctagcatggctaagggggggcactgcatgggagggagcctagctttgatcttcagagcatgctctgcctgtcacaccttgtcacatatatggctgtgtgtgtatgtgtgaccagcggaggggttagagtgggtccatagagtcaccatgcgtttacatgtcatacatttatgtctgcttagcacatgtgtggctacgtgagcactgcctgggctcatgtggacacatatgtgcactctgagagttgatacagacattggggttttatctgtgacatcagggcactgtgcggtatgtggtggtggccccatctggccccagggtctctggctgtgtgactctggatcctgcaaaatgccagggaactcctgacttcctgaatgttctctgggcatgcttctggtggcctcagacaatgttgtccccctggctctggctacctcatctacagggtcagaccttcagatacccatgggcttatagccagagctggtctgctctccctgattgtgtgtccctgggccctctgacctttgtctacagattgaagctgccctagtagaactgactgccctggtcaactttgggcaaggctgccttagctctaatgagtatgtaccaacatctacagcgagctggccttgtttccacatatgggtgacagatcatagtgtttgggaacctgttgtatgccagggatggaattggcatcgtggctatgtctactgtctgccagtgtgttggggaagctagggagccagactgagaggtgacctggggtcaggctgtaggttcacaaagagccctgtggtcctgtcctggagcaggtgtgagggactcagttaggcctgggtgacaacactgctgccttgtcctgtggctggcaggcacactggtcaggcgagggtggtcaaggggattgggggaagttgagacctctctggggaggaaggtgggtagagcctggcagggcagcatgccagggaagaagtgcaaggaagtggctggacctgcggtgtctgggaagcagcagagtccacacagcaaggacccagccatcttagctgggggatgggcagcttcagcttccaaggtggcaggagatggtgagggagggagtatgagagggagtgaggctgaggcagtcactgaggaagtcacccttcttagggtgtccccagtcctcaaggagggacagcagacttgtccctcagccccttccagcacagccttatacaagctagcagtgtggtttgcagggcacggcgtcctagagacccctccccccagatgcaaggctctgctctagctgtaagcacagttcctggtggccccgctgtgttaagtgccaccccttttgcctaagcacagagctggtgctgattcccacagagctgtcactcacaccaagatctcatagctgagtcaatattcctggctcagtccccatcttatgccctggccacaccctgaggctgctggtctcagggtctcagctctgcacagaagagccaagagtggaccttagcactaggcagaagttggttttcttgctagcttgagaccgcccccataaaccattccgctgtctggttcgggtgggtgggttgagattgtctgccctcaggtagctctgccgtggtgctctcaggtgaggatggtgacttcagtggacccctgaattttcttcagcatctgctttctgacataggggttcaggctctgctccccccacagtcctagtccctgttcccctcttcactccctgcttcctgtgaatcagccctggtggtcccagtctgggcagccagccagcggaggcacaatgttgtcttcatgtgttggcctgagaggagagatcagcctattgaggggtgcccccacagccatgggccctctgcagcatgcttctgttttcctaatgaggcctggtttgtgaagggaggggatagaggccagaaatagtcacactattgtgagatgggatcctagaaggccccggtgtcccctcccgccgctccggctctgaggtcagcagacaccagaggcatccaagcctggcagaagacagcctggttagccatggtcggatccttagccagcgccaacctgggagggactgagggctccttgcagggttgactgtagtcttccctgcagatggggctctaccctcattccggaggtgctgggtcctgtctggtccgagtcctcgtttaattcctttcttctctttgccccacagaagaaagccgaagctgcacaccgcatcctggaagggctggggccccaggtggagctggtgagccaggcttggcttggtgggcttggtggaggtgggggggttggcggagcggaatagagcaatggggcgggcagcaggtgtcaggggcagtgggaggggacaggaggaagtcatctactgcccagcactgtccccaaggggaggcaggaagcaacacctcctgataaggccactggcagataactcgtgagtagctgctgggcagagagcatgcccgtgcctctgaagccagcccgcatgcacgcacgcacgcatatccaccacgttagctctgcatgagagtccatccacggttggtgtctctagactcccttctctgagcatgatgactgtgaacccctcagaaggactctgacttctcagtgttgccgcttgggtcagtgcctgcttgtgggaggaagggtggccatgactctagtgattgttatcattgtcctgctggtctccagtgtgtcacagcttggtggggaagcagccccggctcaggggtctggagtggatgaagcagaagcgcgcctcacccacccaagcctgctcttgatggtgtagtgttgggtcatgtcagtcacaggtggcaggtgttgctggtcattggtgcatagggtctggggtgcgtgtgagctcccttggtctagatgagtcctggccactgcgtacttgctaaagactgtagggcgggtaccttctggccaggtctgaggtgtaccctagcacagtcttgtccctaaagaacctagggtagaagatgggcgcggggttcctctgctgcctgtgctctacaaccccttcctgggacccgggcagggctgctatgtggccactgggtctctctcgcttctgtcatacactagtcaccaagctgtaccatctgctgcatagtacttccttccagatatgtatgataccatggcctcaaggagccctgtgtcgctgttcttgatccttctggccattttctctgaatggagccatgcagtccatggccatttgttctttctcgctgtttctgcctctccccttccctcagcattggtgttttaggttctcctacatggagacctgtgttggtgctttatcccttttcagagctgcatcatattccattgtttctggactgcattttatctttccgttttcagttgatgaccctaggtggcttttttgcttttgtcaactgggaataaggccacacgacaagagtagggacaagcagcatttgtctctggagtctatgcctggtagtagaattgccgtctcctgtgttggattttttttccctcctggacgttcctggctggtatctaaggtggctgtgctattggacattcccattagcgagtgtcttgcctctgtttcccccttctgccatcctgtccagattcaaggtgtgtatgcgtgtgcgtaggcatggcgtgcatgccgggcctataacctttttgcccttggagagaaggtaatgtctgttgctgtttgaggagcgcagggcagctggtccctggagatgttggcattggagggagcaatggcctatggtaaggacacagagcggtaacctgctgataggcacttgctgtgtatgtctttgggtgttgccaccttcctcactttctggaagaggctctgaagggtagtgctctgcccagcaccacacagagagagaagtgtaccagcctgttagtgtggccatgtcttcacagggccttctgtgtgtatgtagggctaacagtgtacacacctccctggatactgccgatctgggctttggtcattgagccaccgtggattctggtgccatgatacaacacttgagccaaaagtagcttagggaagggaatgggtttattttagcttatatgttaaatgtccatcattgagggaagtaagggtggggactcaggcaaaaacttgaagcagaaaccatggaggagggttggggatttagctcagtggtagagcgcttgcctagctaacgcaaggccctgggttcagtccccagctccgaaaaatagggaaaaaaaaaaaaaaaagaagaaaccatggaggaacactcctgttttgctttctcacaagttcattcttagctagcttcatcatacaacccgggaccacttgcctagggaatggtgctgcccacaatggttgggcccttctgcatcaattagcagttaagccctacccccaccccaccccccacaaaaaagggggaggggaccatgcccctaggaaagttttatcttagccttttctctcaggtgaccccaggtggtggcagattgacagtgaaagtatactaggaaagtcaggggtctcccctcctcagttattgagtacatcgggagccttggcatagtaatgacaaggtagtgaccagtgaccatcttgccctgtgtaccccagagggaggtaggaacttcaaggattctaccttgggagcctcccatggcccagagtgtcccaggagagccccgtgctgggcagggaccaggctggccaggtgggaggctgcacagctctgagtcacttgcttccttcctgctctgaggtgtcattctgagagctcagtgtccccatgggctgggtttggtcactggcttgccgccagtctgaagggcacccacacccacagctgtcaagggctccagtttgtggctgtagccatttgtcttaatggagaggtcagccacacccctattgcagcaggatgcaagccaccaggtgtccctgagcctccccaggatcagccctctgctcctgtcacgtggcttcggggtgtaaccccagtgctgagcctagggggctccccctgagaggctacagtttcctccttactccccagaaggcaggttgaagtctgtgccctgctgccaccttgggtgtgggtgttccctttgccctcccaagctgggagcctgttttgctcacagccccttgctggggtcagtggatccgagcaagcctccaccccttcctgccccagtagggctgttctccatctttgaaaccaaacaatggcaaactgtcaatacatcagcactgttctaggctgttcccatatcctgcgaggcaggtcctctgccctgcacccattttctagatgaggaaatccagactcacgtgtcactggagcctgagtccttgagcaatacccattcacattggcatttgttttcattggcatctggggaaacaaaggatctcgcacagctgccctgggtaccaggaaagggaacctccatcttcacaggccctgcattcctgagacaaggccttacagcactcctctgcaacgttggacccctccttccacagttatgcagcgagtttagctgcgggtcctttcgttgccctatgcagtcctccccatctctgctagggatgctgcacctgttcaggctctgaacccacaggaggcgctggtccacggtctcataacaagaagatcagttaagcctggctgtgtcctcccctggtgcaccttactgtaatgtgcagaaaccggtgtttccaatgctgcaggggacctgccttgtctctgagcagcaggggacccattggggaaaggaatcttgtgtggttcccacgctggtccagagttgtgttttccccttggattctgtgtgtgtgtgtctagtaacccaaagacccaggacatgacaaggttccccacggcggcgtgagtgcgcaggaaggaaagggcacaggaggtgggtgtgggaggcagagtcctcccacagagtcctcgtggggtggagttcaggtcatgggcacatttggcaactggccttagtcttcccatccgtgcagcagtagcgactgccacatgagtaaccaccctgacaatgcatcagattcaaagaagctagacacccgcccccttgtccctggaaggcagcagaggcctctgggaagtagtgtgtgggaggataagggccactggtctagcctctgacctgtgacgggtcccatgactgcccactgctcttacctcattctcccatgtatgtggacctagctcatgagttccctgctgaggaagcctgtggtgtcctcagccctagccctaggcttgttattccagggcagatgtttcttaaatttctgtctgctgccattgtggacattgtgtgcacacttatgtccatgtctgagactcatgggcatctggaatctcaggccagcttcctcggtccagagcagaggccttggtggtctcttgtaggccagtgtggggaggggggggtcacttcttggcagtcgtaactggactcttcagaagctgtgtgactgtgcctgccacccgctgccctcagcttcttattcttggtttgttttggtctctgtggtccagggaaagatgccttgttagcactagggctgtaggtttccatggtgatctagatgccaagccaaccctaagtgttttacagataaactacattgctcagggtcgaggctaggcctggtccctgcagttgaatcctagagccagctacagccttttcctggccaggtcctgctcctccccgtgttcttgtcacactcccagtcatatatctgattattcagccagtggatagctaccagtcagtgccagggctgagagtgcttggtgtgggttctggctggtgaccctagcccaccataccctgtcacccgtcccatccatctctgacaggattcttcttcctctgcagcctctgtacaaccagccgtccgacacacgccagtaccatgagaacatcaaaatgtgagtcactgctatagggtaccagcccagtcctggggaccaggacaccagtgggaagtctgggtgggaagtcccctgctatagcaagcccacgctgggctcagaacaggcctggagcagcttgggtacagagactggaggcaggaggccatggtgttgagaagagacaggctcttagctctggtctgctctggtgcacacttggtgcccagggcagctcaaagcactaatccagaggtttcatgagccatgccccagtgatgggtcatttcccgggcagaggttgggaggagataatgtccctttggtgtcatatagtggggtgacgcagggatgccaggcagttctggtgtctgatggctggtgtccttaagctggagggtgtgtgtggaatgactgtaaggtactggcttcctgggatgtttgaatggcagtccctcccatcagtgggcagtggaggaaacatttctcatcacctggaaatcaaaaggtggggagcggcctggagcgcatggtggggtattaggtgtggggaggaggcctggaggcaagggtcttagggatccagttctgaatggtcccacaatactctgggaggtgcacaggtattggctggtggcattggagcatagcttggtgagcccagtaggtggtgacacagtgatctggttagtgtcctgcaagccagtgtccctcttggttctcaagtgtcacagatacaggagacttctgaatgtatggcttttggagttgtgtgatgtcacaccctggccacctcctggaatatctaaccctgagggccctgtactggctgtcagtattgggtccagctgctgccgtggctgtccatgttgtctgtggtccactcattgccctgagcctgagtcgttctgcttctctctgtggggcctgcccagctggccctggtccccatggggagatgggttacagaagagagatgatgacagttcattataggggcttgtcacagttgcttggggagagggtgtggaggggggagtgccaccaggccaggctactgagacattgatttacttgtttatttgttcattgacttggtcactctgtccctcagttattttacttgttcattcattcattcactcgctcgctcgctcgctcgctcgccggccgatgttgccagtgctgttctcaccccgtggagtcaggacagtacaaaggcttattccgcgtttgggttttgacaagcagcagagaagagtgaggggttcagtcacggagaaaatctccactcgcctgaggcttgctcagccctggctttcatgtcatgacactccttggtgggtttcttaagtgcgtcggaagaagatctcattggatggccctggctagcccagagccttctgagtgctgggattccaggatgtgctgtcatacccagtctgacgtagccggtgaccggacgacaggctgatggttttatattgcttttgctgcttacagtgagtgatgttcctggggatagaaacagtcatggacccaagccaaagaggtgtgtgcccggacagtgtaggcgacgttagccttagcttagctgtgacccgtgtcacctgtgctgaccaaggatggatttggaatggatttctttgatgccctttgcctctattagaatctgtctgggcttggtggcataggtctgtgagcccagtgctctagaggttggtgagtaaaagatatatccggggctacaaaataagacaatagccttaaagctagctagctgaactaccttcctatctacctacctacctacctacctacctacctacctacctacctacctaactacctgccagacactgatagctttaaaaatcagtaagtaaagacagaagaaaggaaacaggggtcttgagcctatgccagttgtggtgaccatccagctgcgttattctagctattaagtcataaatatggctctgagggagtgacctttcttacgcagatagctagttttctgtttagtaagtccatctgtgagtgcgttgtgagctacgtcatgcttagagtgctagggcttgctgtaggcgccattaacatcgtggccactgttgcttatttcagagttacactgctaaatccactgcgaatgtgccccgagaggagagaatggagtaataggagatgggggagggagtctggctcgagaccggggcaggatgtgctggtagaagcctgagcagctgcctggctgtgtggagcatcccaggcagctgggaccagcagtgcaaaggcccttgggccgtgctgagctgctcgagattgcagactgccgcagccacaggcaggatcagtcaggcccaggagggtgcttcttgtacttccgctcggtcaccatccgcaaagctgcggcctctcttgtgggatgtgctctgctacgagtttaccttcaggttcactgtgatggccactgggagaaaggtcctgccgtgccgtgggaaggccctgaagagctatgggcagtgaggtatggaaggtcaaggcatcaggtctagggtcccgcccagggctggtagtatgtggtaagctgcctcttgactagcgccaccactcactggggaccacacacttcagctgtggccctcggctccatcggccgttcttgaccccattcctgctgctccggcctgtggatgagtctgaggaacggggaagcctagggctgggacgcaaattttgcttttttaaaaaaattttttttttttggttcttttttttggagctggggaccgaacccagggccttgcgcttcctaggtaagcgctctaccactgagctaaatccccagccccttttttaaattttttttaagccccttttggacagagtttgcatacaggttgccatttttaaagtctgagcagtagctttttcttggtcacttagggtgagcttgtcagcatgggctgcaacagcacagtgtcagggaattctgtctttttgtttcttccggtcaaggactcctctggtcttctctgtgtccttccgtgttcctgatgtttctcataggtgggggctgggctgccccagtcgctcacagtcctggggtaggtacagtgggcagcgcggggtgtagagaccaggctctgaaagtgcagatagcttcctctggactgagactacttccagagggctgctgggtagcacgccctgtgacatggtgaggctcaggcccgggaagctgcttggaaggcagtgtctatgtgacctaggtgaaatgtcaggagttcccaggcctccggggtggatgaagtccttaaggcctgggggcctttggggttactgcctaattgggtgagaaagattcagaatggtcagcctcacctcctaggggttgggggttaccaggggaaacagaattccctaaaggtggagccaggacctctggagtcacgtggcggtagagactcagctctgagaaaacggactgaacagtgttaggctgggggcgtgctgtaatcccagctcgcaggggcctgagactgtaggaatgagtgagtctagcctaggctgtctagcaaaagccagacaaacagacaacacctgcattaaacagacagtgtcagggttggggatttagctcagtggtagagcgcttgcctaggaagcgcaaggccctgggttcggtccccagctccggaaaaaaacaaaaaaaacagtgtcgtcagagctgctgatgcaggtagtgagcggcccatcactgggaggtatgcaagccaagagtgctataggttgctctctttggtttgacatgcagcaggagggagactttggcttatcagttgccactctggaaagcgaagacctgggcccactgtgttaacagtccctcaagctgacacctgtaccttacgtgtgggagtggtaccagggggttttgttgttctagtccctaaccgtagtgacagttattcctcacctctttgttcaccaagcacgcctccgtgtgtctgtctgcaccaggcactgtctgtccctgggagttaggaggggatgagtccctacttgcagtggagaaatggcaggctctctactcaggcggagtgtgacagccgtgacaaggacagcgagattgatccggggttagtggggagctccaccacccagggagcagagccgtcaccactcctgggctctctgctgtaattgctgagaggtgggaagcgtcccttccctggggacctggcccctgtcattttaatttctctgcctgcgtgcctggccgtgactttcaagttaatttcatgcttggcttcctggggtgggtgatttcagacctgtggaggtcacctgtgctctgcttgtctcccctgccggtgtccggaaagtgtcactagcagctgaggttctgccagggcacctgccacctggactgggagcctgccctctcccaagggcttagatctcttagaatccccacacagggagggcagccccaagggcatgccggaggagagcagtgtaggagctcccagacctgcaggaccttcaggagcatccatgcctggatggcgtcagataagtctcagccgagtacgatggggctggacagccaccgccccgcctggggtttgcctacctgcttggtctctgccagcatggagccttggacctcgagtgtctcaggctcctcttttcctcatattctaggcccgccatctcattttcaagatggacaggaagcaggttactgggaacatgtctctggtcttgctctggtggttcagaggtgccaaatagcttccccagggtcacagagcaaagacgcacatgtctctgtgtctctggcctggcaacctcagatagtcagtcacattgccttccccactagcaggcgaggatgctcgttaccacagaggctctcgggctctctaacaccctgttaccagcttgagcaggcataggtggggctccatctaattgtgccttgggacagttggggtcagacccttcttgaccctcatctcatccggccaagcccaggagctcagctcccctcaaccgcctttgttcaattccacgtttgtaattgccagcaggcagctgatttcatggctgtttgtggaaggcctccctttgtctctccaccggagttcctacattcacactagtattggtgtagctccccattcttccagtagcaggtggctgtattccctcccctcccgcttctgtccccctctcctcttcctcccttttccctcttcctctccttctcctctttccccctctctcctctgctctccctcagcccagaatcgcctcagacttcctgtatggtacacaatacctaaacttctgatccttctgcctcagctgattcccaaatgttgagattacaggtatggaccgcattttcatgtggtgctgaggattgaacctaggacttcgtgcttggtaggccagcaagccacgtctgaggtcataggcatgggacccccaggctctcactccaaggtgacgcccttcagtgggaactcttagattagggacatgtgaggaagttggggttccctcacccgaaaagtgatgtagccatgatcccgggttagagagggcatgttcaggtgtgtgatggtgatggtccccaaggctctctgtctgtgtctcccagaggtcagttacagtgcctggttgagtgttttaggcctgtggggtgtagggatgtagcaggtctctgctgcttggagcgtgtggtggatggagtcctgtattccaactgtgctgtgcctaccctcaggatttctgttccctctttgcagtctgagctttatcttgcccgtctgtgtcttttttctaccctctgcctccattttctaaatctttgtccattctgaggtaaatctctgttctcttctctctccctcccttttccttctctcagtttctcccttccacccctctctgaccctgctcttctacccatgtctgcacccttgttttcctctcttcctctcagaatccttccccgctttcctcagtaatacttgcagagccttgtggggggctatggtcaagctggtacagtggagcggggcagtctacccaacctggagactcctcgatgcctttagctgttcataggacagtgtccctggccatagccattgccacatgactcatttgcctccgggtagcaagggttgaactttgttggttgatacccatggctgtgactcagggatgaggatgatgcaagttggcaagtgtgggagctctagagatggcgggcaggtggtactagcagctctaagggacaggtaggctcttgggaaagggggagtgggctccctctgactgagggccagtgctaatcaccgtgagctcctgctgagagctggccatctccgacgcccctgtctgtgctccccagaaaccaggcgatgcggaagaagctgatcttgtacttcaagcggaggaaccacgcacgcaagcagtgggtgagtcccgtcccgtcttttccatgacatatacaagcagtgtgtgagtctaatccggtctcttccataccatgtgtgagctgtgggtgagtctcatccctatcccgtccctcccctccatgtgttatgaaagcagtgcgtgggtcctgttctgtccgctcaacacacgggcaagcggtagatgagtcctgcttccattctgcccttctctgaatccccacccctgtcccctctcctccattggtgcagtagataagggaagccctgtgcccccatggccattcaggagtcagagcctcttcagcacatgctatccaggctcccgaggtccctgtccactctgcagctgtcggggatgggtgtctgcgtcatgagagaatgctgtagatgaaccctaaaggctgcagctcctgtggtgtttggggctcctgacctcctctcccagccctctagagtggggagccactgaagccaatagggtcttgaatgcatccttaaaatgtccttcatgggctttagtgcccacagttttggagagagatagaagctaggggtgtcctgagagacgatccttcccctcctccagccaggtccaggctctggaatattcggccattggaaagcagcaaggccctggtctgtggtggtccgttcttcgggagggggtgagggaaacaattgcactttgacccacaggaaaccagggctaagggatagaggcaaggaacctgccatgttgccttagctgccagggttgggagtgacactccaccattatgcctacttatgtagtaccggaaccgtgtagctggtttgatttaggccttcacctcccttcctgggctctgcatgcagtctctgcttagccttgatcctgaatcagctctgatccagggccaggcttcagttggaggtgatgtcatccattccattcagcccgggactgctgggagacactgtctggtgtttgtgtgtgtgtgtgtgtggtggggggtgcgggggtctacgatgtcaagatggcagactcgacccttcctgggctgtcacatggggctgcaaggtggtccctgccccctttctcaggttggccttactcagccagtcttactcagcagtgcctagagcctgcgggtgtgtagtaaacagaagacagcaactaagttctgcttgcactgaagtggaatgatgctggaatgtgaattgtgggtgaagaggagtcagggagctccccagtcatacgccttcagctgcagtcccgagtgcccactgtgcatgtggttcctggcatgggcttcaggaactgagtttcccatcccagaccttttctcctcatcagtgggcatggttccatgaggtgggtgtgtttgcacagccccgtatttcaggcagggaagctgagacggagaggttagcgcgttggccccatgtcacacagctgagtagtggcagcgtctggattggcaccggggctgtcttgttccttagtcctgggtaagcagatagggcctgggcaagctgaggtagagatgagctccggagggaaggtggcctcagcagtggaggaggaacggccctgctgacttacaggggcgagctagttgtgtacaggtctttgctgagggagagcatggcaggcgtaaaggccctggggttggcgctcaccaggacctgttgaggcttatcctcccagaggagcacaagtgcattcatggtgaatctgccctcagtgtgggatgtcctgtgcgtcgggctgcaggaaaggacgatagttgcatgaccacaccctcgctctaagatcaggctggtcagctccaggatcgccatgtgcagaccacaggaccacaggaccgcaggcccctgctgctgatggacgaggagaaggcaggcgtggggggggggtccccttaacatcctgcaatccaaccctgccatgccattgggccatccctagatgccactcacagcttgccctgagtggctgccctcagctgtatctgccgtcccacgtcagaggtccttgcggctctctgagaggagccagtgaggtagagggggatttggggtgggcttggagtcagggagctggtttttaaagatgaaggaaaagcctccgagtccccttggctctgcagcccaggtggtccgccataggctgatagacagagaggtctgcctcctctcctggccaagcaatgtcctgctgtctttagacagtggttgtcaaaggatccttgctccgatgtggaaccaagtgcactcacctacccagtagatgagacagactgcagcaggccacactgtggtttgacctagacagacactgtcctgtctcagacagtaccacacccccattcgggagctgcttgggcctttgtgctattgcctggggctgtggatcgtgtgggatgttcctgaggtcttgggccctgttacttgtctgcaaggtatgggacagccccagccctcagctggtgactgactgacgaagtcagctctgatgtcctcccctgtctctggcctctggtctctcaagtattctctcccttctccttgggcttctgggtaggagccaagagacctaggctggactggtggaatgtgtgtgggcccccctccatcccccaccccccatctgcccttagccggagtccaataccttggactattgttcaactctccttgagccatagacacagggcgctccgggtcagaggttaaacacactgtggcaggtatcagggcacaagaacatagccaaggtgttaatatgaccatgtctcccgtccttctgtagctgttaggggcgggatttttgatctccttggatacatacagggcgtgcggctgtaccctgggcttgttggagaaatacagcaggcagcttggtggttaaaccgggagggggacttcctcatctgcagaggagggcagaaccttttttccaatgtctgctaggtttggggttcttagatctggggagtgtggctgcaccagagaccagggacaaggaactgcctcgaaagcggatattccctggggacaccttttctgggccacaagagctctacagagccatgccgcccaggacaactcctgcagttgggcggcctggcttgatctgcttcacggtgtccacggtagccggcgtgaacacagcacgagcctcaggctactggttcagggctgtttctcatttgtgtgaccgagggaataacttgacgggactggaggcttctgaggcagatgaggcccctgaggggcacctgtgactccccagggaccagcagctctgtgactgtgacagagtgtgtgtgtgtgtgtgtgtgtgtgtgtgtgtgtgtgtgtgtgtgtgtgtgtctgtctgtccctccccctcccccatccgtccatgtgactgcagtgggcagtgtccggccctcaccggcgtgcctccttctggccatggccccctcacaggagcagcgcttctgccagcgctatgaccagctcatggaggcatgggagaagaaggtggagcgcattgagaacaatccgcggagaagggccaaggagagcaaggtgagggagtactacgagaaacagttcccggagatccgcaagcagcgggagctgcaggagcgcatgcagaggtaagggcgccacggaggacagtgtgcacaggggtgaggggtgcagagctgagggcaaagggatcggcccacactagggagaacacaggagtgagtgcgtgcgtgcggaagtgaaggcccagagcggggtgagggtactgaggtgagcacatgtaaaacagctctcccagggatgagcatgtatagagggttcacgtgggcctctgctggcttgtgcccagagtgccctcacagggcttcacagttacagctaggcaccctccagagccatcactcatgagctttgtcttgctgttctcactctcccgaccccatgcctgcttaaagctgctgagtgcgactctgcgggggggaggggggggagtcggagtggggacgggaggatggccgggcccagctccgaggtgggtgcctgtcctcactgtggccatgacgggagaaacctgggcaggctgtctgaacaaacgaggctagctgggtgtggccacctggatgcgtaggctcatccgacttgtctcaccgacccacacaacaacatggtcccaggggctgatctgaggtccagaaacctgctcctggtcctcgggctagaggcagcattgggttcctgctggatctttgtcctttgttcatgggagatgggctgccatcttgtaacctctgggggttgacattcctgggctctaagcctctggtcagatgtgaaggtggggtctcagccctggtctccccatccccattcattcacccatacttaaccctctagaatgttctgccccatgatccaggcctagcctctccgtgggatggctggtcctgactgtgtccttctggtttccagcagggtgggccagcgtggcagtgggctctccatgtcggcggcacgcagtgagcatgaggtttctgagatcatcgatggcttgtctgagcaggaggtaagtccacagtgacactgtgcacaccccatcgcttttgaatgtctctctccatgtcatttacacatagcttctgccatgatggtcaggtgccagcaggaaacctagtgctttcaatcccgaggctggtgatgggcatccgtcagaagcgatgtgggcaccagcaataagtggccgtgccaggccatgcctgtcccccaaagggcacagatgacagggatacccacaactgtgaaggaaaacatagttggggaaattcactgatccaaaaagcctctagtgcctagaagggacatcaggaagctgggttgtgggacagggataagtgcccctcactcctctcccactgccatggttcagggtctctgctgagcttggcagaactgttagggggcggtctgtcagtgagagcagctggggccagccgaggaccttcctagaggagcctgccttctgcccgttgtccctttggtcttccctggggacccagtgccaatcttggtggggtgtggtcaccatcacagagaaggccacgaagcagagcaggtgcttgtccccagagaggtgtacatggccgccaccacagtggacccagaacaccatgtaccaggacccttgcttcttttctggtggttctgctctcaggcagagatggccataacacctttgtcccttctgaggcagttacgtggcaaccctggccatgtatcaggagtggccgcttaagtggcctccttgtcaacacagacagccctgtgcacgcagcaaccttaccagctcgggcctgcaccccactgaatgcctggcctttaagggacatcctcttgctgtagttctgctggaaaacctctcctcctcttgtgggcagaaagcagaactcaaaaatccgcaagcggcagccatggggccatcctcgctggcggccatgcggctcggttcaacctctgtgccacagatgtggatgcaggtgtggctttcgttttctctggaagcagggagacagtggccctgtctacccacacattggacccttccttaggctctaaccacacaagagtgttgtggctgccacctttttggggagccattgccagaacaaggctggagacagagtctgggtcagaaccagagggtactgggcaggagacacctggcaccttcctaacatggacaagccaggcagccatagaagggcaggcaggcccagtccccaggggatgatggaaaagccagggccagaaagtgaccaggctctctgcgtgccctgtgctatcccctggatttctggctctaagccagatatgtgccatcccgagtgtgcgtggagccaggctgggccgtgccctgtccctgccttcacagtgttttattacactgcctttgtgggggtgagattcatggcctctcctactgcagataaggcctcatgctgtgcactgaatttacggcttttactttccttaactaccccacaactctaaatcctctccagcaccagccacggctgactttttaattcatcatccctcccctaaggaatgccccagggccggggcacccacccctcaccttggaggccctgcatttgccccctgaccccaccctgtgctctgctgcagaacctggagaagcagatgcgccagctggctgtgatcccgcccatgttgtacgatgcggaccagcagaggatcaagttcatcaacatgaacggactcatggacgaccccatgaaggtgtacaaagaccgccaggttaccaacatgtggagtgagcaggagagggacaccttccgcgagaagtgagtgtcctccgcggctgcctgggagccttgcctgtgtgctctctgttctcacactgtggtcacagaggcactgatcagaactcccgctgctctggcggtgaagggatcctcagcccctctctgcctccatccttttaggagtcttaggcatttgtcttctcgtaggtaacaggtgtgtgtctccttgtacctcacagaattcatcagcagacagctccctccacataggctcagagaggcgaggccgcctgacagacgtagagcgcctgtggtgtggaggcaggcgtagctggccgctggaatagagaggccgtgtagggaagccagggcttcagtgatcaggaataggctctggtagttaggagatggagctcagctgagtgtggttgccaaacctttaaccccagcaccagggaggccgaggcagggacatctcttctactccagcccagcttaatctatacagtgagaccctgtctcaaaaagtgcgtctccaggaggcttctccagacagtttaggggagacgagtttgtgacttctgggtggaagaccattttagcccagggtgaggacctgaggtgttgtctctaggtcaaaagaaacatcccgcgttttggggagccctggaagaggtggtggtatagatgtcacgataatattcttatgtctgttatttgggccagtaccctgtaacactctaccttgaagcagaaccccttcctcagaggaccaggacccctgagaggctggagcgaagagattgaagcagggactgggccggcacattgcccaggaatgcctgttgaaggggaggttctcatgcaacaggcctctgttgagcagagtggctgacctgttttccctccagagagacccttgtctgctgggggaagagtagtccagggtcaggctgtacctgcctttggaaggacgctgtacaacaggctagccccatcccagatcacagacaaggtttggccgctacatggggcttgggcacaagcaacagtcttcaaagtagcatttggctatagaaacacacacacacacaaaagaatcccccgagtctgccctattggcagctcaggtcaggagctctctcctttgtggcctgtatctaggactcttgtgcctaggactcctccgtctggtgtgttttatgacctgacttaggatagtggtcctgagatggctgaggcctctgtgtgtcctagtgtcttgctaggcctgctgttttaatgggcaaacacttaggggtactttagtggccggcccttcctagataagtctcattgcacttcagacctagtgatttactctgatgattctatagctgacaaactgatgacctgatgtctactggtgcatcttctgtttacgcaaggcacagccatattatgttggtctttgaaggctgatggtgtccccggagggcttacttgccaaggtgctgatggcatccaaactgacctcagagtaactcagatgtcacttgctgaccacatggccatgcacaagccagcctcagtttcctcctgggtaaaataggcatggctacatagcattctccttgtgcctgtggcagccacttctgccccaacaggagaagctaggacacccttctgtgaaaaggtgatgatttgcatgagacctgtgtgtccccattcttatcctggggtcggtcacactactagatttaagggaagtccacacgaacagtcgttacttggagttttttagggacattgccactggaaggccaaatataaatatggtttacacaggcccaggtggtgagtgcgtgcgtgcgtgtgcatgctcttgtatgtgtaaaactttgttgcctaggggcaatggggggtgccgctttattttccagacagagtctcatagctcaggctcgcctcaggctcattgtatagtcaagtctggtcttgaaccctcctcctgcctcaacctccccagtgctaggatcatagacataaaccccatgttatgttttatatatacacgaatgtgtatatatatgtatatatatgtgtacacaatgtatatatatgtatgtgtatacacacacacacattttaaagacagggctttctttatgcagtgctgactctgaaacttcttccctcagcccatagcactggcaatctaggcatgtactgctacggttgacttcttttgaagcctaactgcccgtgattggttgaaccttagatgtagtaccctgtacatgctcccttcaggagcgacatgaagcgcccaggctaggccaaacccattcatgtgtgcctatctcacaatgcctctgagccacgcgttttcattttttttcctgttttagttctgagatgaggtctcactaaattgccctgcttggtttgaaactcactgtaccccaggctgcctgtccacctgccccagtctcctgagttgctgggtaacagttgtgccatcagacccggctctcccagattctggtgaactgtggtggggagagggacaggtgccctgcagtgtctcaactttgatttctggtagcctggggcccatcactgcctggggaagtcctatagaagggatggtggcaatggtaccctaggcttgcctgccatgggggaaggcgggggggctggcagggtagccaccgtcctgctgctttgctacctctgcttccttgggaagagtttagaggctcttccggattccccagtgtctggcggggagaacgggaggggcctctggcctgctgcccagccacctggaggccaggcggggcagcccaacaccggctgcacactggtgggaactggccctggactgctggcagccatttcttctccctggagataccagggtggtggcaattcactggagacaagggggcaggctcagtgacgccacccagcaccctgagggtgtaagcagaagcaggccttgaccctaccctacccccacagctgcctggccctgacatttcagctggccggctttcccagtaatgctcaggcttcgcaggaagcctgtggctcagagccagttcccgccaccccctgcggctccagccacttttggcttttcctgggcatccaaggctctgtcccagccttattggaggccttattgcctggcttgtgcaacctcacccaggcaggcttggcttggcgtgggcttgggcctagctgggccgagccaggccgagtcaggcccagcttcttagacccggctgggaagagagacaaaagcagatctgggggggtgggggaccccactggcaagctgaatgccgtgtcctcatttttcctggaagcctgcagcaagacaaacaaatgtattttcaaaggcattactgccagtgagtcactccgaggaacgccctggaccctggtccctgccccgcagcccttcccacgccctgaagatctgctagtggggcggtgcccgcccagccaggctggggtggcaggcactgggcactctcaggtcttggctgtcctgtagggcctccctcagcctcagcctggcctcaacgtccttctcttctcccaggttcatgcagcatcccaagaactttggcctgatcgcctcattcctggagagaaaggtgagtgcccatccctggctggcagtacgggcactaagccggcttgccatccattcctcagggcctatgtctgggctgggtggagtgtctgcccctcctctgtctctctggccagctccatcttttttcctgcctccgcctccttcctaagagggaaagccaggcaggccccacccgggatggggaggagcctcaggcttcaggcccaggccgcccaggaaagatgtggagactggcatcacatagccacttgcccagtacactgggttgggcgccagttctgagagttttgccatgttccaactgaggccttgtggccaggtatggcctgcatccaggtctgtgtgtggagtaatctcctgggtccttgtcacgggtattacgggctttctgacaactgtagataccacttccggcgtgtggctaacacgcctatcattctgagtaaaccttcatgcagaattgatatttgaacccaacctgttccccaaaccagagcctggagcacttgctctggttctgcttcttgtaggtaaggagtcacattgtccccagagggctaccgctggcttttactcacacaccaggctagcctacagtacacgaacaacccttagtgggcaggtggcagcattggctgtacgtgggagttggttctgtaggccccgcacctcagctaccttggccgaccctggagggccgcagtttggatctagaccctcaacagtgggatgtccagcctggctgacccctgccctgagtcttagggatgttgggagctggtgggaggtggaccgtgggatctagataaccattttcatagacagtgatcattcctcacaactgatatgggctgatatgttctggggagacggaccctctgggatgtggtacctgaagaacgagtgttgggaaccagcattataaatagcctacctgtctggtgaggcatcctgatgggtgtgggtgactcagtagtccctaagtttaaaggctggcgctccacagagccacaatagctctgagattggagattgagtaaggctgtgggggagggaagaggaggggaatctgagggagagaggcactcagagaggatctagatgaggcagatcagtgcttctaggacacaggtggctgctaaggccatttctcattcctgagctggctgacacacaggtcctctgggtcatgggtgtagacgagggttgccttgggggaccctgtggacatagcgtttgtccatggcacactccaagagtggtctgatttgtaccaccccacagtcctcgtgttccctagcttggccctaggtcaaacatgatgggcacggacgtctcagacacagataccacggtaggctccagtgaagcttcttgtccattgtgcgtaagttctgggttaggctgttcaggatcctgggtttccaggaaggagcacagagccatgtgtggcaaaggctgggttggcattgctctgagtacccgtggctttgttctccgagggagctgagctgctgtgatgtcatcactgttccctacagttccaaggacagggtctgtgttgatagcctgcgactctgccgtctctccacactgggctctgtcctgtgtgtgtcaccttcagagtaacccacttgaccgcacagtccgtttctacatgtcacaagcgagccgcttggtattcagagaggtcaggtacttgtcccagggccacccagctggtcatcagaggaacaaggatttgaatcaggcctctggctcctggctcctactgtgcattctgttaccccattcactcctcagtgtcctctctctgccctgcagacagtagccgagtgtgtcctctattactacctgaccaagaagaatgagaactacaagagcttggtgaggcgcagctatcggcgccgtggcaagagtcaggtaagatgtggcatggactgcttggccttggggaccgccgctcctgcactcgagggacccttgccgggtggtcagtgtccttgatgattggcgtcatacagttctaacattagggttccctctgtatcatctgacctgaagagggtgttggcagtgtacagaggtggaacctcttctgtcttggctagggtgtctctggctcagagctggccaggccatagtcctcacggttagatggccacatttcagggctggagagatggttcggcacgtaagagcacagactgctcttacggaggactcaagtttgattctcagcacctacacggtggctcataatcacctgtaatttcagttctaggggatccagtgtcgtcctctggtctccgtggtatcaggtacacgcacagtacagaggtacacatgcagagaagaacaccgatacacaaaagtggggacatacgcaaagtaaagacagcccaggacaatctggggagacccactgaactcccccaatctgccccttcactcatgggtatttgaggggagaaatagccaatggtcaccacatgtgtttcatgcctcggtgtctagagtgccagccactggcagcttgcagttctgctctctacctgctgtgtaaataaagctttattggtacagccattattgcacagcttacagcctacagcgtcactgtagcaaaagctggctgatctgaaagatgttaggtaaattcaggcaatgcacaggaccctgatgcacaaaagccagggattctgggggtgtgacttttgggaggcggagagagattcactgttcatcgtcctctctcagattggcaaaggtcaggcctcattgtgaattgggctggaccatcataaacagggactgctgtcccataaaacagccattttctggtccacttaaagcgcagatcggcggggttggggatttagctcagtggtagaacgcttgcctaggaagcgcaaggccctgggttcggtccccagctccgaaaaaaaagaacccccccccccaaaaaaaaagcgcagatcgggaggtcagtctgctaagacaagtgaagccccccagtcaaaatgtccggcaagctggtaaagtgcctgcaatgtgagcgtgggaacctgaatccaatccctagatccacacaaaaagctcggcatagtggcacaagctcgtactcccagtggaagagaggtggagacaggatactgtggcttcagcctgcctactgcactctgtaaaccctacagagactcggtgtccaagtacaaggcagacagctcctgaagaacaacacccgaggctgacctctggccctccggacccacgtgcacacagatacagatgcacacgcttgcgggcatgctcagttgaacacccagggctcagtgtgtgtccactcttgcaggatggctggatttggtctgtggctgtggttttctagctcattttctgcgcccacagtgagctggcttgcttggttctgaccaatatgtgactccacagtgttgtggcacagagcagtgggcacactagaggtttcgctgaggcattcaggaatttttctaggctgaggacaaaaggtcagttggacaccatttggaatgttgggaggcattgggtttactgtggagacagggggacccgtgtgaatctttatacctagccctgtagagataagtggaggggatgctgttgtctgcctgggtgatggtgatggaggcagtgatggtgatcatgatgatgatggtgatggtgatgatggtgatggtggtgatgatgatgatgatgatgatgatggtggtggtggtggtggtggtggtggtggtggtggtggtggtggtggtgatgatatggcggcaatgatggttttagtaataataccagcgatcgtggtctttggtgatgatggttgataatggtggtggtaatgatgttggtgatattggtgttggtttggtttggtttggttttccatgaaagggtttctcggtgtattccttcctgtcctggaactcactctgtagaccaggatggccttgaacccagtgcactcagcctgatggtgatgttcgtgatgccagtgactgtcttagttacttttctgtggctgtgataaaataccattgccaaagcgacttacagaagaacaaatttacgtgggcttcccgttcttctcaagagttgagagtccatcccggtagggaggcttggcagccagtggcaggtgtggaacaggagcagaaagtgagtgctcatgtttagaaccacaaaggccaagcagagagaacaaacgaggggtagcgggtagttcttaaacttcagagctcacccctggtgacaaacttcctccaacaaggccacacctccaaagcctcaccaaacagaaccaccaactcagggccaagtgggcatacccttcaggtctagagaacatctcgcttcagccactgctggttttggtaatggtaatggtgatggtgacagagtagccgtggtgaatgtgacacattgtcgcagtgccatgtctcgtgcatttgaatgtgaaacagcctaagaaagagaagagagaagtccttggggattccctttctacttagagacctggggtcatagctagctaaaggaacatccacagggtcggacttgctccctaggctgtgggagctgagggagtacagttgctctgccgggatcactgggtaacgggcctgcctttctctttgcccagctgcactgcctctgggcctcatggagggctctgcttgctgggcctctctgtactgtagggatggagtgccaggttctgtgctgtggtgacatgtcctgagacagggctgagggtggcgagccactcccactgggggtgtcctttgaggcagagcaaggctcggccacacctggtgtggttttgtccctttgctacttctgatggctcctctttcctggaggaggcctgcgtgcctccagcagctgctagggctgcctctctacctgttcttttgctgtcttggtatctcccctacactgttcctcacctcctgctccggggtggcccctgtttgcagatgttgcggtgcctgtggtcctggtgtggttcctgtggcttccggccacactgttgcttaggaaagccacaagtggccgttcctttcctcagcccaccagtgacactcagaaggctccccgagagatgtctgtttggtggataggacgtgcgcccatccgagcacgtattgagtgcttgctgcatgctgtgattggagaaccattatgggggggtccctgtgtaacagttcagaaagcactgagaattctagcaagccatccccactctcagactcaagagttgcagggtagacaccaggtagtacttcctgagtgcttctcctcagactctgcctcctgcatgccaccttggggaagctatgcttccagaactgactgcctccttacccaccccagagactggggcctcctctgctctcaattcggccttgatggtattgaaccaagagaggagtggaggcagagaggtgaacctaggagcaccttggcatttagcgcctagctgtccctgaatgcactgggatggatgtccgcggagatgtggcctcccaggtttagccgtctctggttgctagcatctccagcccaagactctggttcttcaaaacctgctgttcatggagtatccccaagaacctcaatcctggggaccagcacccaaacaagcaggggaaggggaacttcagacagcctcagggccctttctggagtgtccctaagcaggttgagatggccatagacgttcccttggatgtgtctactatgcgtgacatgcctgtgtctccacctgcccctgaggcatctgagctggcctggcccttggttagccaactcttctctctctgtcctctacctgccctgtcagagtgcttgttcaagtggtcacatttttaaaaccgcagaggttctaagcccctgatgaaagtttgtgggtatccgtgatggccaccagtgtcctgccatctcccagcccacccagccaagagagagtgagacttccccgacctcagctgcccacgggtgaggagtgcagtgggccatctggagtggtagacttacctattgcttacctatcagagcagctcccgttctagaagcttctctggcctctgcccaaggtgaggcaggctcaggcatagactctgaggacggtgacctcctgaacctgttcttagggacaggatcaggaccatgttctggcatttttccccaagcttccccattggctaatggtcctgactggatatctgtctgatgaccactcctggtccctagcccagatctctcaccaaggctgtggtgaaagtaccatgccaccttctaagcccagagccatgaccggttggcagatgctgtggcccttctgtggtggagagggacctgtggccgatcaggcgtgtctctgagggtagactagatcattttcttgcagacaggacatgaacaggaaaagtctgtcctggactcctgacctctggaccagccccctttgctgagggggaagtcttcatcgtcactgatgtcagccctcacatcctggcccacagtgttctgtcggctgccccctgaccctctatctcactgctcttcctggccttggtcatacaggctgttcacactgtctgctgccatgtgtagcttccgcctggcctctcttcctttttctctgtgtggccctgtctcttctttgtttctgctgtgtgtgtgtgtgtgtgtgtgtgtgtgtgtgtgtgtgtgtgtgtctgtgtgtgtatgtgtgtgtgtctgtctgtctgtctgtctgtctgtctgtctgtctgtctgtgtgtgtgtatctgtgtctgtgtgtctgtctccctctgtccatccatctgtctgtccttgtctccgtgaccctatgtcacttcctcttttcctgcctcacctcttcacccaccttcgttgtgtctgtctgtccgtctgcttgcctgccttcctagctctcttttctctgtgaccccttgtcacctcctctttgtccccatttcacctctttatctactttccctcccccaccttaccactttcctctggtcgcttgccaagggacagatgaccttgttcccaggcagggcccagattgcctgcccaggagcagtctgaccaggagacccaggacagcaccagacagacttgggcagtgtatggctgtcactcttcccttgaggaccagctagctgccccttgcctgtgaggtcaccagagaccgatggttggagcctgtgtgtcacgctaagccacagcaccctggctagaccatttggttgttggtcatcagcgagggtatgtgctgtgtctcaggccttaggagaaagcctccagcctaagccctgaagcttcttgggttcagcccatagaggactgattgcttagctgatttactggggatgttttgtgcaagccagacttgtgccagtttaggctcagctgagcaggtagccgtggtttgctctctcctcagaggccctcctccaagtccacagtcttgttagacatgcctgtgagaccctactcagggctggcagctggggagcccaggaggtgggagaggctgtaccctatggctggaagaagctggatcacttctatgggaaatgagaaaggttcaagatgcttgactggaccaagacacagcacagggggcccagctcccccaaccacccagactgaccacataggaggtgggaagtgtgggttctgttggacatggtccatcactcagctgggacagacatcaccccggtgctcctaaaagctacttactgcttactagatcagtggcactgggagctgcccacatttgaatcaatttcgataattccgttgtgaacgagacaattgaggaccctggagagccccttggaggtggtgtggaggactgctaaaatcctgggggccgtgtgatcaggggcagctttcagggctctgaccccttgaaggaaggagccagccaggcagagatcacagtgggtgcaaaggtcccaggaagggaccctttagttgcctctttctgagggcaggagggaagcaggaataaactaacatgtggagggaggcccagcatggatgtcctgtgtgtttaattctggtggcagggcaaggtgtgtgtgtgtgtgtgtgtgtgtgtgtcagtgtgtcagtgacagagacagagacaccttccatatcatcatcaaccaagaaaatgcaccacaagctggtcttttgggggcattttctcaatagagattccctccatctaaatgactctaacttatgtcaagttgacataaaactagccagcactcccactgagtcccgacttgacgatttaaaatggagccttggggatggtggtcagctcaggtacaatgcttggctagtttgtgccaaagcctagggctctgtcccaagttctgtagcagggtctccacagcagagcagctcaggaaagctcgaacatgaatgcggggagccaccatggtgtgtatgaagtgctgctgttaccatgtaaattcttcctcttgccaggtctgacccaggcctcagagaggtgctaaagcgcatgccatgtcctgttcctgccccaccattcaagcagtgggagtgacttcacagtataggctggctggaccacgtcggccacagctagaccttagaggcgccatatgactcagcccctgatgtctgtttaaaagctgctctctggcctgatgtggtggcacaaacctttagtcccagcacccaggtggcagcggcaggaagatctctttgggttcaaggccagtctggagctctgggcttaaccaggactacatagtgagaccctcacaacaacaaaagccctgctctcaaaccagcagcaaggcatgcgtttctgttaacatggtgtgcctgtgctttatgattggctcttggtattccacacactctggtgacttcagcacagctctgtggacggctgagcctgcaacccttgctatgcgtgcgtccctgggagaagtggatgggtacccagagcaggcgtgaaggaggcaccaccagctgtagactgtggtcttcctctgctctgacccccatccctgttttcctccactcacccgccctctccccttttccacataggaagttcttgggactcacttgtggggcgtttggtttgttggttcttgttagtacagtgtttattgaatgaatgactgagtgtattagtcaggatggctctgaactgtcaggttctctttcgtttatttaagtttgggatggaatccaagggctccccaatcccttcccttgatcttggccgccacacagccctgaagacccagtgcaggggctgggtcttaccaggcttcctcatctgaagggtcttggtgactcaaggccacacagggctgcttgtgccttttgaaggttcaaaccttggcattttattgctgggaagagacaccatgaccaaagcaactattataagggtcagcgtttaattggggctggcttacaggctcagaggttcagtccatggtcatcaaggcaggaagtatgacagcatccaggcagacatggtgctctagatggatctgagccttctacatcttgatctgaaggcagccaggaagagggtcaggatcaccctggccagacttaagaccatatgagacctcaaagacccgtcttcacagtgatgcacttcccctaacaaggccacacctcctaatagtgccacttcccataagccatgcatatttaaaccatcacaaaggtttttacctatgttatcacttaacacctcagtcctgactgtgtcagcttcatgttctgtaagtttggtctttacacttcctggggtcttggtgccccctgtagacaagagtttgtttagggtaggaatagcagttctgctaacttggtggaaccaagagtccctgaggaggttatctttggggttccatttggctgcaggctctgctaggaaatgctgtgtgaccttagatggattgctttacctctctgtgtcttgttctcatctgtggaacaatgtaacatcagggttgttgggaggagcaagaagctggacgtgtgatgtgaggacagttccatcccatgcgtgttgtcagccgacacctgtccttactagtgtcgtcctctggaaggaaaaacgggtcctagcagatctgaacagatacatgaacctccccgaggatcctttcagggtgttcatagtgctgtgatctgggggtgggggacatatgtggtcaccttgcccataactgatgaattgccacttgattctgggggagcgtggcattctgcctctcctgcctccgcaagctggggctgaggtctcctctagcgtcctttctaccatgggatacagaaaccctgccggtttctcactctggtctgaggaccttaacagcagatttgtcaggggctaggtaaacatggggaaccttgggatagcctagcatcagcctatagccaaactccgcctcccatttgcttttgtaaataaagctttattggcatgtggtcattcccatttgtggcagagccaagccaggtgccttggaacctacaggttgtgcagcctgaagtcctttagataagacctcgccagccaggcttaaggtcctagtctgcagtgcgctggaacagcctgggagttcattttattttcatttggatggttttgaggcaggatctcaccctgtagccctggctagccctttgaatttgtcacagtcctcctgcctctccctcccagctgttggggtacggggttacacatgtgtaccaacttgtaactacgctggggcattaaaaatattgatgctgcctccagcctgggctcacagtggccttggcacggttggggtctggcagcctttgggtgtcaggaagcagagctgctcgtgaggctacaacaagcttgaaatccctaggcatggctggccagcgctgtcggccagacttgcagactgggatttgccagcctcaagcgactggtcgtagggacccagtacccgcttcaggtctctcaggagccaggaggggccaagcatatgggttcattcaggccaaggcagcctaccctctgctgtcacccccatccacagaggtgcagccccgggtgcagagacaccttgtggttcatgccgtgggcagccagacctgagtcccccacccagccctctatgtggaggcgggaaacacgacttgagtggcttggctactgtgcccctgcgtgggacagctgaagccagatgtgctgacagctgtgaagccttccgtccccttgagttctcacccccagtttttatggcttgacttgggcacatgaagagggaacaccgttgagctgacaggaaactccttcagtgccagggcaaacgaggcttcgcctctgggctgtatggagggttagaatctgaaagaaggactcaggctggccgactgacatctggtacccagctgaggagcctgcagccattcgtggctacttgtgggtgggatgactgccctggcccctcattagagaacatgggattcttggtagttggagagagtgaccctgaggaccctgaggacacaaaagcattgctttaagagcgcactgtgactacacaagtcaggcttttgccgtattaccagtatgtcatgatgcccctgtctgtccccagtattgcctaatcctataaaagacaaggccctaaagcgttgtgcaccgatgtttttctgccaggaaggaacaagggagggaaagggctgccccccctcccacacacaccctgtgttggtgtcgtccctgcctgcatcccacctactacccgcctccctgccagggctttctgcaggtgcccttcctctgggctcagtggagaaggcaggaatcaaacccctgtgcccaagtgcggtgctttttaatgctccactccgcctccgacctctcccagctggctggcttcccagctgccctggcctctgtgttcaccgaccctcccttccccagcttcacctgtctcccgttttccctcctgcctctgctccccgggctgtagcagcagcagcagcagcaacagcagcagcaacagcagcagcagcagcagcagatggcacggagcagccaggaggagaaggaggagaaggagaaggagaaggaagccgacaaggaggaggagaagcaggatgcggagaacgagaaggaagaactcagcaagtaaggccttgcagctgcgcagctcacacctgggccctggggagcagagcctggcgccggtttggagccccagccagttctcccaggcctttcctcccggaagcctcagcccccgctccctgcatcccccaccctctctgcacacccctcctccccgccccccagagacctaggagactgattgctcatttgagccctgctccgggactcataaatccagacagccactttggcactcagccttgcatcccctccaaggcccctgaggtccacaagggagagacagctgaagggccccctccgggggtggggtggggcaacatggatgcaagcatctggcagccctcacctccatactcacccccatcggcacctcccagccagtgggagaaggtggaggggccgcaggtgctgtggtgggcccttgcacggcagagcctcctccttccccgtctccttccctgtctccacggctccagccagcatctttcaggaagatgaatgggtgacagaggtgataaatctgccccagttgcttctgagaagcccggtccccaggtcatgtgcacccccacggctcagctgggctgcgattgctgtcctgtataccctaagcaaatcgctctgtagaggtagagaatcaagtcccctgtggctagtgagggggctcatagagtcccgaaggcccctagccaggcttcctgtttggtgtgtggtgatggttggtgctgtctgtgagcatcacttgaggctccactggtgatgtggagtcgggtgacttcacaactgcccttcccaccctcatctggaggggctcccgctgcccttcagggctgagatactgctgcagggcctggctgcccatggcactgcctacccacagcgcccttttggccagcagcagctctttcctctctccagctctgagagagcgatccaaaggtctcccccagttgtcctgggggtgtccagctccagctgacccatcctgatgcctcttccatgacggcagggagaagacagacgacacttctggagaggacaacgatgagaaagaggctgtggcctccaaaggccgcaaaactgccaacagccaaggccgccgcaaaggccggatcacacgctccatggccaacgaggccaaccatgaggagacggccaccccgcagcaaagttcagagctaggtgagcaggctggggactgggagggaagacaagcgaactgccctggaactggatttttgggtttccataaagtgtttggctaactgagctcattgtgacctggaactttctctctttgcctcggcatctgcatgtggacagagagaaaatatacacaagaatataagagattccagaagctctaaccaggttggggatttagctcagtggtagagcgcttgctaggcaaggccctgggttcggtccccagctccgaaggaaaaaaaaaaaagaaaagaaaagaaaaaacagaagcctccaacctgggtgcaggcggagcctaggactgggaagagactgtgaaacccacccctcccccacacagccctctttgttgagttaaatcagaagatggggccctgtggacccagggtggtgatgagctggagaaaatagggtgtgctgggctgcagttccaggggcagccaccaggggcagcagtgcacactcctcctgtgtcatcttggctgtttgggtctcttcctgggtgggtggatgtgagtgggccagttctgtttctctagtgggtctgcagtaggcattcactcctcttgggactggcttgggcttcatgtatgagctgctggggccagtgcagctttcctcaagttaggatataattgggattcgaactcaccccactgaccacaaatcctgtgtggcttttgtgggagtgtggcagctgccagttatggtggcagtgtgccagaaggcctgtgaagcgcacctcatatgtggggcagtcctctaagccccggcctggtgcttggactagacttggaagataggaaatacaccctgggcttttctcagtgttccagaatcttctacccgtagtgtgcaaagcctcccatggaggtgtgtgtggaaagacaggggactctgagatccaggagacagcccggggtttgcaacaggaatggacataatttttatccgttttcttcctgccttgaactactcgctggcctccctgtcccctccatttgaatctaccacattgtgcctgccacagttctcaacactccccaggcaggggctcatagctgggccactgcaggccacccgcagggcacttggtgtatggcgtgtcatcccaacaaggctgcttccgcccaacctgtgcctggctacgtcccttctgaagggccttgttgtccttggacaagctagggagagtgaatagtcacaggcacaagaggaggcctagccatggtgacatcattcatgagacgtgagcaaatgccgaggggccattttgatggttgtggtaggagacaggctgtgagcattgagaacagtggttctcagccttcctaacgcctcagccctttaatacagttcctcatgtgaatccccttccccaaccataaaattatttcgttgatacttcataactaattttgttactgttatcaattgtaatacaaatatctgatgtgcggctcctacgggggttgtgggacccacggattgaaaaccgctgatctagagggtcacgtctatgaaacgacccgctctgcacttgtgaccgtgtccccaggtgggccaccccgtcctagcgacgtgcaagtagaaacaggtgtcctgatccagtccctggccacttctttccttgtctgcgaatgtgcgaatggagagatcagattcctcccagcatcacaggctgtggtgctgcccgtgagagcattgcaggggcgggggagggggctgtgtacggtgcctggccccttaacgtgagcatcaggcactgtggtagggggtggctgggattgggcctctgctagcccagagcagaatgcagggaaagcatctgtggaactcctcccaatgcccgtcgtctttgcagcttccatggagatgaacgagagctctcgctggactgaggaagagatggagacagcaaagaaaggtaaggcgccaccacgatggtgtgcactggattgccagtcttgaaaagctgccggtgcatctggcagggagcaggggctctttagagcctcggttgaacttgccagagaccgggtctctttctcgagcggtgaccagtacctgaagtcaggatggtgcaggagcctgtggtttcagtgcgcgagtagctagctcaaggtggttgatggagtcacagttccctggccatgaaggccagccacggtgtcagtggcaccgggggcactgtcttctcaccagttgtgcggctcttaggtggggtctcagaggtccccacgctgggtgcaagttcgtgctctgcaaacgttgggaattcacgcctaggttttggtggtgtgttcctcaggcctggcgtagtcataataactgtctacatcccaaggccaagactgagttttcaaaatcagggagtcactggctgttggtgacatggcaggctgtgttaggccatgtgctagggtgctctgaggttcacatctcactgtcacaccttgctggtcagacaagaccccgtaccccagcacctctctgagccctgacctttgaggggacgcctcctggggccctggtacccttgccctggtgacatcataacctctcccttgaaaccacagtcattatgcccgagccctcactttccagcttatgataggtgacctatctctgagcctcagtttacccatctctaagatgggagtgccaggatggctataaggagttgaagccaggcattaagattcttaagatgggcggctttcactgagggtcccagagctagcaactgtgtctgtccctacttctgccatgtacttccgagagacacaaggccacttgagtgtggcattccagttggcttctgccttagttgccacctgacccttctctgagatgtagcttccatttctgccccctattgtggatgaggagtccgggctggaggcctcccatagctcctgaggatcaggagccagcccagtcctctcgcccgcctctcatccttcacacactctgctcagaccctgcccctgcttctgccccttggctgtggacgttgtgttcacactgccgtgtgcatggtggggaccggtggcttttattaggagctgccgccactgccacctgtggctctggtcctcagacctgctcctcctcactcctgtggggttcgctgggggtctgctgggcccagcaggagtcccacaccacctgagagcatccaccaacctggagggtccattgagtattcctggttctccacctgagcaaatgtctttcttgcctttgccctctttcacccaagggtgggcttggccggggactgggccaacgctcggcaaggacagcaatatctgttcacagggctctgagattgtgtctccagatggctgggtgcggtgtgctgtcaccccagggggactgtgtggttctttattttttgtgtctacattgtggtttgtggtatgaattctaaaaggtctttacataatggtctgattcccatggtttaatctcctcaaagtccgtataacagacctgaccactgagaagctactaacccgggcgttgtgcgacatgcttgtgatcccagcccttggaaggcggaggcagggggattgtgagttccgtgacaccatgagaacagtgtcatgagttcatagcaagtgggaaaccagcatgggctacctgagaccctgtctcaaacaaaaagaaaaaaccccaaagcacacccacctatgtttgcccacagtggtatgctgcaagcttccacgccctggatggaaatcccgaacccattatcggtccctcctgcccatcagtccaggggcgaggcagcactaatggacttccggtctgtggctagaagtcattttgccctgacacttacaggaatgatgcctgctgccgctgtagtccgcatgcctggctgcactcacttagcgctgttttcagggttgcttgtgcacctatgagggctgtagagctatgtgaagctcgacctgaccttcccccccccaacacacacacacacacacacacacacacacacacacacacacacacacacacttcgattgtgggctcacctggtgacaaagtggtgggttattcctgccttgggctctgcgtgcttctgtggagatcatgtgacccctttgcttttatccacacatggggtcctggggtctcagcatactgactccaaagtgctcctgggaagtgcccagatcttaaagctcatgctggtgcctgataccgggaggctgctctctcccttttggaagggcagatcaggaggtgggagggggtgggatgactcaccagctgggatggagctccccgatgccactgtctcaaggttagggcctatagagagggctgggagctcgtccccactgatcctggggcctgtgtgcaccagccctgctcagtgacatttgaaatagcgccgtgagcgccggcgcgggctgctgctgtgaattacagcaatctggacaattatgcctgcttgccgtggctgctgatggctgttccggaggcgggggcggggaggcaggtgcgcacagcccgaggtagctccttttccacagcctgagggggtgagaggctaagaatgttccagagcaccctgccgcgagagtgctgacaactcagagaggaaaatgaccccagccaagctgtgtcccaggcagatggtacccacccatccttggcccagtgtggcgtaggagcccacaagagaaccaggccctcagggaactcaggcaggtaagcaaccaggtgtctagagctgccggagcgtcctctgtacgtagcccagctgtgaaggacagctgcagaagaatccagcccccagagaaaccgagttggatttcctgtgtgtggtctagacccgtcactttcttcacccctacaaccagtcactggcatcagcacaataggaaatttttctctcccttgctcaggaacctagaggtgcaaaggtgaagtgtaggcagggccatgttccttccaaggccccagggacagttctgcacttagatcctaccttgggtggtgggctcaggctactggctgccttcccgtggtgacctcgacacccctccccccattcaccaggatttccccctcctcccttcccccatccctccccttctcgctcactcgctcactctctttttaagacaggatctctttgtagccttgaacttgaagaggtgcccgcctctgcctcctgagttctgtgattaaaggcgtgtcacagattctttataagttgacccaccccagcggaatgaccgaccattctgctcccttggagggtctgtccctgtgataataacttctgggcggacataaaacttgagctaggagcattgcccagctcagcacatcagagcagctttttgatcaatagtcaataattactcaatagccgaccttgaagtcctgatgccttaggcagtttggtaccttgccccagccccatcacagctcctgatctgactgcgtcctcatttccacctcgttgtcatttgctcgctagaaagaggcagggaggtctgcctcccaggttcaacatcagggcaggagccaaatgtttgcagtacttggtatacagtgggtgctcaagtgcagactgcagggcagcacacaagctggattggagtcctaactctgcctgcatgggatcgatcctcgcctgtctcctgaggggtgggatgcccctggaagttgctcaggcacaagtggagccagttaactatggaggccaatgcttgcccctgtcctgctttgaggcagctgctctgaatgcagataaggaaagaggcccagacgtgtggagtgagcatagctgtgatgtggggggtctgggattagaaccccagctcttgagttgcaaaacaggatttagtagggacgggattaaatcggttgggcggtctgtaggctactgctttaagtaatggaggaaggaaggaagggcaaccagtggggcagatagccccgtgtcagggacagtgcactcaagtgagacattagaaacccagacagcgcagtgcgggtgtgtgagaggaggaagtagagaggccacagtggcatcggtgacaaaggtggggtttcaaagggatggaagggacctggagttggattccgcctacccgatggcccatgatctttctgtgtgtggtatatgtgtgcttagagggcagggctgctttcctgggctcacagaggctgagacctgagcacgagctggaaactgcctcctcaggacctggctatacccggggacctggccctgcctccctttggacaaagaccacaggtgggtgggggtttgggtgctattgggctggaccaatagcctcaggttccccaagagaggttagcccagcccctaaggaattctgaccgtgaccagagccagtggcttagaccagggtcattggatgctgtctccagagcaggcagtggagtgtcccatgctagctatgttcagtagacacaccctcccttgagagccctgcctgccagtggtctcgtctcatccttctcatggttgagtacctagacctggtgggggtggggaggctcagccactgttctgtcagagttcatgctgtccccattcccaggccagactgaccttcccaagagtacagcaccatgtgcctcactgggggccctgtgcacagcagggaagtgggctggccaagcgagcagtgtgcccagccaatggccagtgcactaagttcagggaccatgaacaccaggcttcatctaagtgaggagatggtgagagggcgggagatccccataggcaggatggaggtgaccctgaagaagtctctggagggccttggcctctagtgttgatccccaaggagaaaggaggctcccatgtggactgaggtatggccagacatgggtcatgctctggatgcttgtccctaatcagtgccctaaaggagatgttgcgggctccggccttccctcactcttggatggcatctgacttcggggagggacaggtagtgaatggcccttgtgatcccagtttccaggtgcaccgtggctcggctttgcccatgagaaagtggcatgcatgaggaatatggctcattggtgtagccagccagggctctgggggacaggacattctgaccctgcgaaccaggctgcctgtggctctgtaggtgggcagctggccctgggtcgagccctgatggctttgtctgatgtggtacggagtacctccattgtaccagtgattggcaagtacaagtactgaggcctcaggggttgcgggagaaggcagccagggcgggttcaagggtaaggtcatcacagatgactccgcagagctccctgtgctggtcctcagcgatcacacatcctttgagtctagagcgggctcaacatttcttaaggaaggaagatgtggctagaggcctcaggacgtggagaacatgtttctctggcttcttgctctgggaaggttttattttgcaagggagtctaagaaagctggtgtgagggtggagcctggggtgggggacccccctaagcttcttcctggggggatctggaagccccagcctgagggagagtcagtcctcctcccatgttctgtcagaggctgacacacttgctgagtttagatccctgtggaggggatcgggactggacagtcacagacagctcttgagtgcttcatgggtcccaggtagcacatgagaaagggtcaccttttgccaccatttctccctcccctttgtggctgctgggctccttcagctctctgccagcttcaggccctgactcaggccccctgccttgacttcctgtcttggccaatttcacttcctaagtaagctgccactgaaattccttccttagaaattagtggggtgggagaacccaagaccgcaaggcaggctggcaaaaccgttgctccgagccctcaggcctaactctcccaggacggatacatgggacctccaagcctcagacactgaggtgtctagagtttcgttcctttttgagagccttttgcagtccaagcacccatgggtacggaaggccagcagtcacgaatgggtctaacaaagagctggactcggagtagatgctacggagatgaaatgccatcctacctccctacccacccaccccagcgcccaatgcagatgtcctggggccttctcagggttgggagcagtagagctctggtttctggagctcctcagccttaggggctttagggtttccttccagggacatttccacaggggttgctcacatcggccccctttggagttccctgtggagcacagtgggattctgtgggaaagagccatgttctcagcactattgggagctctccgccagctggccagggatacagggaagctccaatctgtctgtccctgtcctctgggcttctagaacagaatggaagggcaagggctagaggaaagagttggttctagaagtcagcctgaccggatgctgctcgaggaggtagctcagttgtctttgcctcccgggagcacttgggaccttaccgtacgtgctctcagagaatagaggatgtattagctagccagggtccccagaccctaggccagacccctgggagtcccaggcccccaccaccaccaccacaaatggttgtggtgtcagagtactcctaagtagatcccaagttccccaccctccacccccctagaaaaccttggccacccacagccctctgggaggctgactggtccaggctttgggggcctgtgaggaagggggggtgcgaccgcaggtggaaccggctggctggcgggagggctggctggcgggcgggcggaagaggctgcttgctccctgcctgccgggggtgggagctctgtttttctggatccctcagtctgttcttaccgctgctgacgctgccacggatggggagagagggagggagcctgtgccagttggcccgcccagccgaacctgggcctgtgcccggcccccgcccgcccccgcccgccgcgtctggaggtcacattcagtcctgacgcggctcgttgggtcaggcagcaagaagagctgcgcggagcccagggacccacagcccagccgtttagggacacagctgcctggtcctgtcctgcccagagcttttggatttcgtgtggcttggtgggtctggggtctccgggccagcaccctcccctagtgtcctccctgagacactggtgcctggaagatctgcggacgccgcgtgctcactggtgacgcctggcacagagaaacccagcacacagaactgacaacttcccgctgctgtagccctcgctcccctcccaagcaggaagggcagtgctcagctccctggggcagctggtagcagcgcaggaggagtcccgggcccacccccagtgcctgcttttgccctcacggctcctgaggatgtgaacagaggtagaaccaggggataccagcaagaaagcttaagcagccttgcggccacagcctcctaatcgctgctccgctccctggagcatccttccagccggatgtttccggaaaacttggccgagggggagacgcagatgagaggatgtgagtggtccccagcccgtgatggggctggagggtggggttggctggtgactgggactttgatggggctacaggaaatttcgactgcacgtgtggtggtggtggggacttggaattttggacccgtggctctgtctccccttcccctatcaccccttcttgcctttctagggtgcagccaagatcccctggaaggaggctgtacttagtctgggctccaagcttggctgggacattctcagaggggctccccggggtggacagggcagctgggctgtctttacaacatggggtgcgaagtattcccgtgcctgcacagcaccccaacgtaaggctcctagaacgagagcggaggagctcgtgtgtccccggggttgtgtggctcactctgggaagggctgtccaacagctcgcccatcgccatccgtgaccacacgtgttcagggacagctgagcgtcatcccccgccctgtcagctccttgcttctataggctgagttcgttgggagacccagctgttccgactccttgttgacttaactgaatttggaaatgtctgctctctggggtctggccattccccctcaactcctcaggcaccccacccccaacagctccaaatggagacttgccctggggttccgggcctgcgatccctcggcctgacgtgtttgctgggccctcttggactgcactcccgtaatataaataaacgcagccccagccgccaggttctggaagtggcagctgctgctggctcgggcggagggaaaggtcaggggctgagttacacttgatcctgagccctggccctccctgcctcctgcccttgaggatcccggagaagcagcgatggagccacgtggctcctgtggtcactgtaggccagcaggtggcctggctgccctgcacctcccccatatcatggggccccctgaggaggcggctagagtgggaagctgaggcttcagaccccctcctgagctgggtgaggtgggtgggaaacattcaggaattccaagcttgaccagggtgtgggggaggggcaagacagactgatttcacagccctatagacctagggggtcacttgctggtgggttgggggtattttgtattttttttattgtttcctttgtttgtagtaagccaccaactggggtttgaatgagggggtggacccctacccttcccgccccgccttgagagatcagatcctagcagttacagcctcttgctctgctctggtgtagaagaaaatgatttgaagcttggtgatcccaaatggctttggagctcaggttctggctctgccctccagtctcctaccctcttccgccaggggcaggttctgcgactgccagggaaagtggccagatttgcttccaggggagctggggcccattgtgactagagggtccacagccttctcttctagctcagggtttatggcctcggagctggagagcaaatgtctgtggccttggtggggtcgaagagggggtggcctccacagattgtcccaccatgtggtctcaagctgtggcttgagacagatccacccgagactgccgagtgccaggtgggcgctgagcctggtgtggctcctttggtctgaggaccaagctcaccctgctccgacctctgctcttccagctcactttcctcttcacctatggtgagaccggaaagcaggcttgttctcctgaggcctcgctgcagctgtgcagtgtcaaagctgggtcaccacagctcccgcccgactggggagggaaggatgggggaaggctgtcttctgccccctagaatcttaaacgtggcctcacttgaggccatgcgtgttaccgtttgtttcctgatatccctggctgtgcccccttggtcctggactgtagtgaaccctcacctgccctccacctacaggcctcctggaacatgggaggaactggtcagccatcgcccgcatggtgggctccaagactgtgtcccagtgtaagaacttttacttcaactacaagaagaggcagaacctggacgaaatccttcagcagcacaagctaaagatggtgagtctggccagaactcgtgagctggggactggggacagccaggcctcccacagccttgctcatgtggcccctggcacccgcatggggaggtatgggtgggctgggccctgacccagccaggaacctgccattactctcagtgccctggattggagacccagaggctgagagccctgagtgagcggcttggcttctgcctggctgccctttgggacagtagggctccagtgacaggggaggagcgtcccaaaagacagagactgaggcccagggaagctctttagccgcctaaactcacagctgagtaactaccacccttccagtctcctgccatggtctgaggctcgggaggaggccttgcggtccatccctccctgggtttgaaagttgtgtgggttcttgggcagaacccaggggcacccgcctcagcccgctggtgctgcagctgccacctccaagctatcgcttgcagatcgtgttcccctagcgtccgactgcccagctccccgtggttccaggggacttctccctctgctgccaaggacccccagtgggcctgagcacatagtcagctaggaagaggggccaggtccaagcttgtggtctagcgcccatgagacccgaccagtttctccgtactgagccatgtcctcatctagggtgggagataataacactggacagaggtgcgattggcctcatgagccagaaaggatgtgcccgtgggtggagggccactctgtggggcttcctgcctgctcgctctttgtgacctctcattacttaccttatagctacctgccccatgtcctctaggtacctggagcccttgtgatccagtaactaccaagggctgtctactgattgtgtgcgtgcgtgcgtgcgtgcgtgagagagagagaaagagagagagagagacagacagagagagacagagagagagacagagagacagagagggagagggagagagagggagggaggagagagagaatgagaatatgaatatcaaactaggctgtgccacttgtaggctgtgtgactttttagccaagaatcttgttttctctgtgcctcagtttctctgcctgtaaaatgggaaggataaaagaactgcctctgaggtctcgggggagggtgcactcctcccaggtaccagggctctacttggaagggggcccaaggcaacttgccagctcctcaccagctaaagccacaggggtgccgatggcagagggctcagggtcttcgggatgtggtgtatctgtcccaggtgagaggtgggtgtgtgcacagagtcgcccggaagtacagagcgccctggcctggtgggtgtgtgctctggctctgctgccccatggcttgtgctcacagcacacagcttggcccctaggcctcagttcccacctgcttcagaagtgtgtggggaggccttgctatccacggtggaaagtccagggtctggaccaggtcacggagtaggatgtagtccgtgtctcatgggcagaggtgtgacgggggtttcctgaggagcttgctacttccacagtgggatgtggggatcatggagagctgttgagctaaggaggtagctctggtctaagtggaagcaggctgcccaggaagggggtcccagtcctgtccctagctttgtcattcaggtggctgctgtggcagaggaagtctgtagaggacgttagcttgtcctcgccccatgagccgactggtcctaaggaccataagagtagtatgcagaggtggacacccctgaggtgtagagcgagcaccctgttgtgggagtgtgagctggcctttgtcgaagcccctgccccactcaacatcagaccaccctgataaagagggtaggtcaagctgggcttctgtgacactgaggagggttgaggcaggagcatcaggagatccgggccagcctaggctccaggaccgtggctccaaaagaaaattacaggaacgagagggtcacttctgccctcttagtcctcaagcagtgtataaggcctttggctgctggcccaggcctgtctgagagcaggaaggtgtgccaccctcggccacccaggaagcaggggaagacaggaggtcagtgggcgtccctcttgcccatcccgggcctgacctgcacagggctgctggagactcatcaggaaacgggagcttgggcggagcctgcgtgtcgcaggttatgtaacatttggcagcctcgtcctctctgaggtctccctcccactctgtgtggccgaaggctgcccttctgtctgtgtcctggccctcagggctcggcctccaggttgctcagtgtgtctgtcatctgggcgctggccctgctggcctagcttccttctgctgtcttctctctgtggctgctgggagacgctccaggcaggatgtacttgaactccagcaggcgggcctccttgactctgagctctgtctctgagtcgctgtcatcttctctgaggcccatttgtgtaatgaagtgcgtggctctactccaggtgtggagggaggtggctagaacaggcaaaggtccctgttgacaaggaataagtctcgtcaagagatgcggtaacacacgcttaacttcaccagcacgcagcccaaagatgcggagacggagatgcagagagggggggggggggagtgtgtgtgtgtgtgtgtgtgtgtgtgtgtgtgtgtgggttgcaggacattggttaatcccctgggcaaatcagagagggcctctggggagatgacgttggaggaagtgagtgtttgctatctgggggaagggtgttcgggctgggaacagcctgtgtaaagtccctggggctggcgtggggcctggagaagcagacttggactatgcagaatggcaggactagtgatctggagctgatttcaagtgttaggagcctggagtgttgaaagctgcgtggcagggtagctgtgtgtacgtgtgactttgacacctcgaggattcctggtgtgcagtaggtgcttagtaaacgaacactatctgtaatttgtgttcgtgtctccaaaacaccgcttacacatgcccaccagccctttggtgctggggctatggctgggtttcccacaggctccagaaacacagggtgtgctgtatggatagtctgttcgtggctctgctaggccaatgggctcccatttcctgtgagtgtccctgcaacctgctgcctagttcctgttgctaaagatagacaaaggaaggggatccccagacacatgccacaacatcctcgcacccacagactggagcccggcctcccgggaagtgccaagaccagaccctgtgtgggcgtggttggtgaagccaagggccacaaggtctgtgtaaacttagaacaagcctgtggcctaccgttggcaacggaggtggtgatggacagacgggcatgcgtttcccttttgttcctgtatcccaggatcctggtgtccgggacttgggatggcacatctgtagcttagggccggtgtgacagtggacacagcgtggtcatgttatttttcaggacagaatgtcaccagtcaggtgtagcagaactgtggtctgtcaccagcttctgaccctggtgggtttttctgacttgtgagtccctctgccgtctgctgtcttcccctggaaaagctcctcggttgcagtgcgtctccacccaccatgctcctctcccctcctggcctgttcctcagttgctgtgctcctcagcttggactccctttgggtgatgccaaaccagcactaggggtgtcgaccgagaaactagggtgcccggatcacgtcctagactaggcttgcactgtgctcgatccgaaaggcctccatgactggtcattgcaagaccagtgtgtgtcctgactgccgatccacatcccaagctcagagaagcctcagctgcattgggcttctacccagctcagtggaggggcacggaagtggatctggagaggattttgaatgcccccgtgctgggagggtgaaattgggccctgagtgtgaggagtagaagtggtttgggggaaacgcaaggctaccatgtggctgatccacaccccagggcctttgcaaataagcctctctcaccttggcttggatgctccttcctctatactcagacctggactccagtgtcagcctcgccctggtcatccaccggctgacttggccttgtaccttttctatccccatttgatcccactgtcgtccctggccagtcccgccgaggccaaacttgtatgcgttgctcactttggagagtagtggccctgttgtatccacagcccttccacctgagccccgagtgtgccctgggacactatagcccgacccagcctgtacccagggtgccactgggacacatggcactatgaagcctctatggtaaaaatagccctggccggcatggccaatgccatgagctgagtgggaaggctgcccacacaaccaagcagtcacccaagctcgctgccctcacagctgtgactgggcctcagacacggggtctccccagccttgaccgctactgtcctgtcccaggagaaggagaggaatgcccggaggaagaaaaagaagaccccggctgcggcaagtgaggagacagccttcccacctgccgctgaggacgaagagatggaggcgtctggtgcaagtgccaatgaggaagaactggcggaggaggcagaaggtgaggtcactgcctcgggaggaggggggaggcggcggggagaaagggaatgaaaacgtatgcgcacatgcacacacacacacacacacacgatgctctgtgtctccctcttctagggaaccctgactagactggaggcttctggctccagctccccataattcacatgctttctccgtaggcctggcatgacctcgggacacatccgaggttgggccctaggctcttggtgtcaaagaccttacctctttgttacctcagccacccccctgagcaagatggacatagcgtggacgggaagtggtggagacagctgcccacaagagtggggagtgactgtgagccccagatcctggggcacggggtggcttacacatctacttaggagcaggctggggcagggccaggctggctgaggactatcaccacctggggattcctggggcagctaaccattcgcaccccagggcaatgggctagaaaggctgaatccaggctaggggccacttgacctaggacttccttggatggcaacagtcatggcagccatatagccttgtctctgtcaccacatgctgaggaagtggctgaggggtgactgaggcatggaggagtgactccaggtccctaagacctggtttggcagcttggtcctagccctgtgctctgcctctttggcgtccaggggaagggggctggtgaacttcctattacttgatctgtaaagcacctacgatgcccaggctctgtgcacctgcctggtacacatcctgggtgcccagtggaatgcctcagtgcagaactgggctaactctagccattcctgccctgcccaaacccagtccttaaggtggggcccagccacagttgtcacagtccctgcctgactctgagggcttccggtgtagacatgactaacagcgtgtggcaggcacctgcaccctgcctgcttgtccacagaacttcagtggctttggcctcctgtgtcctgttgttgggctgcaaagaggaagaccagaggtcatgccctactaggtggtccaggctacttgcttgcctctcgctgtgtgtcttaatttcctcacctgccactgtgcttcatgagtactctggtccatgaggccctgtgtgctcattaccagcaccatgttggtgttacccatatctgtcctgggagagatgctctgctctgggctccaaaagaacagagaagcgagggaggctgggaactgactgacaaggctggaagccacattggttgagggcctcattggtttgacccagtcactcacacacagctctgtggaccctgggcacatcttggccttgtgggggtcgggggcacactttggctgtgggtgaccagggcttcccttgggagctgagcaagctggtcccatggaagctatcctgggtcccctgccctcagcgagccacacccctctcccttcccacaggacttggtgtagcgccccagttctaactcctctccaactttcttccagcctcacaggcctccgggaatgaggttcccagagttggagagtgcagtggcccaggtaagaatgtggcttttggctgagctgggggccagggcatagtagggtatccaagatcttacatccccatccccggtcctctctgtgctgtttcctcctctggtttgtctctcctacaaaatgtctgttcctgttgtgtctgtggacagcacgctctacccatctttcctctcttccagactcttccctgttccgtgtcctcgccttctttccaggcgtctgtatcccaggcagaaaacagagggactggagacccaaagacgagggagacagttacagtcagggcctgcacgcatgtgcacacgcatgagcacacagagccaagaacctattggagccacagcagcagacatgctccttcacggagtccccgatgcagtggccttgtagctgctgtggtgtcagccttactgtaatgcgctcatggtccctagacctgaactgtcactcatcctgctcagtacccgcggaggtctggttccccattctgtggacggggaaactaaagcttgtgggaagccttgagtttcccatgggagtaccaaaagtcgggcaccgagctgaatggcactcacactgaatctgcagacctcagatgagggaaggcttgtcttgaggccgtccttggattggccccatagcggcactgactacctggagactaggggttggggttgggttctgtgggcagcaggaaaaagaagcagatgttgcaagctacaggggcttgtgagggacaggactcgcccggaggtgtaggagcctgggggctgttctgatactccttgagagtgctgtcacgttcagtgtcgtagcttattcccgcctttcctcttgccttcatgtagctgctgtcaacaacagctctgatactgagagtgtcccatccccgcgcacggaagccaccaaggacgctggtcctaagcctgctagcactgaagcattgcccgctgccacccagccacctgttcctcctccagaagaacccgcaacagtccctgatgagccctgcccagcccctgatgccagtggcccaccatccccagtggcttccccaccacctgccgcacccccggctgctgttgacaaggatgaacaagaccaggctgctactgttccccagaccgaggatgccaaggagcagaagtctgaggccgaggagctggtgattgatgtgggaaagacagaggaacccgaggcccctgaggagccaccagagagtgtaaagagtgatcacaaggaggagactgaggaggagcctgaagacaaagccaagggcccagaggccattgagactgtgtccgaggcgccacttaaggtggaggaggctggaagcaaggcagctgtgaccaagggttccagctcgggtgccacccaggacagtgactccagtgccacctgcagtgccgatgaggtggatgagcccgagggaggtgacaagggcaggtgagaggcgtcaggcgagctgtggttcttgtgtattccgcaaactcagggagcacccttcgtctgccatgacagcacaggtggcccggcctgccttggagtctgtgtctggtttgtagggattaacataggactgagaccagaattaggggtgtcttagtcactgttgtattgctgggaggagataccatgaccaaggcaactcttacagaagagaacagttcatcctgggctagcttacagctccagaggtttagtccatatcctctttgtgggaagcatggcactggagatgtggttgagagctacatcctcatccacagttggggagagatgcagtggggaagggagagaggaagaagaaagttgtgttgtgtgacttgggtgtttgaaacctcaaagccggctaccagggacatccttcctccaacaaggcgacaccttctcatccttctaatccttttaaatagtgtcactccttggtgacttgagcattcaaataggtgctcctatgaggacattcttattcagactacctccaggagggttcattctggaagggtacagtggaaggaagacccacatggggcaacctggagctgagatctggaagggaaggtagccatagaaagctccagggagagaatgaatgttggcgtcctccagctgtgattcagaccagatggcttgacgtaagagtagttggaggtagaaggtccaaatccaggtgtcccggagtcacccatactccaactcggaacatttccatcacacatctttcactactgatggttgcctatagtctctggtttatagacccagcactctgatctcagcctctgtggatattaggttcccctgtacctctgtttaaattcctgttccctggaaggttgccagtctcccatgactacatcagcctggctttccaacgaggtctcatgcactgggcccagcattaggtctggaatgctgggacacagttcttcccttcagaatacttccttagcaaaggccatgctaggagccagccaggtacacaaagggccacatgggccaggccattgtacacgttcccagggtgttaagacacgaaggctgctgtctacaagagccgggccatgactgagggggtcgctgtgagccagattgttccagtgatggaaataagttgctagctatgcaattaagatgaggtcacccagggcccagacactagaggcccctggccgtgcagtcagcccagctttctctctgaggtggtagcggatctgtggagcattctgattggcacactccctgccctaggggcacaccgtgttttaggtgaagccctctgggcactcaagggcaagtctggaagcctcccggtgatcacatctggacagccccacccacctctgggcagccgcagttgttttgtgatgaggcagtgtgctaatgtttattttgactgcaaacagcagagtctgttttctctcccctcaagtctctgaaaaattccagcagagcaagggaggagaccatgaccttcagaccggcccacacagggcccttcctgcttcccctggctcccctctcccctccgggctggtggatttgaaatggaggctttgtagaccttctttattccctgagggctcctctggttgggcctacatggagcaggtggacaacagatggcccagaataagcaaaaggtagccagtgggtttctgagggctcccatgtccccagcttcttgcttgataggcacaacaggggacaaagggcctatggcagttccagtgccaccagggtctctactgagatgagagagtgccacaaggccatagagctgggtgtggggtgccgccctgaataccagccttctcctcagacttctgtaggctctggtcaggctgaggcctctcagttctagctccctttgcccatagcactagccagtagtttccttccatccctggtgtttggtggctagccaccttctctgcttgctttctagctcctaggctggaactcaggaccacctccttgccctggggcccacccgtgccttcagtgagcagctagacttcctggcaggaggcctgccacctttaccagcagcaccatgggggccagggagggtaggtgaaggccgtcaggaggccagcagcctgcgctgctctctgtaacctctgagtgattgcgcccagccccattccggccactctgggagagctttgccgctcagtgctgctgtgcctggggcagcttggcctggagtttgcgatgagccttgcaccccgatttcactttcagagtagggatgtgatgctttccagtagagctggaccttgggaagcacccccacccccacccctaagctcagtttccacacttgcaatgggtaacgatgtgactacagagttgctgtgttataaccgtgaccctgggccaagctcacagtgtttgggtgcagcatgtgctggacaggcccctggagatgctagacacttggccaggagggccctgattccccggtggtctggtgctggtcagaagaaaggcttatagctcatgagacatgcggatggtatgcgtgactggaagcaggcaagccttgagtatggtcattgcttagtgtggagaggaagtttgagcacagggaggagccaggtaggacaaaggccctgtggtctcagagcttacggtcagagcgtctcaaaggtctgtagctgggagtgtagtgaccggtggagtgtgaagaccggagatcatcaaagctattttttttttaaattatgtgcctgtgtatgagtctgtacacgtgagtgctggtgtctgtggaggaacgaggccacagagaacaagttctaggcggttataagccacctggtgtggcttctgtcctcggcaggagcagcgtacacccgagccacctctcttatgtgtgtgtgtgtgtgtgtgtgtgtgtgtgtgtgtgtgtgtacacacctgcctgagtgtttgtgtaccacattcttgtgcggtgacctcagaggcaggacaggacatgagatctagtgttgaaccaaacctgggtctctgctctttaaacagagccatttctccagcgctaggatgtctttctagctttaggtctgtctggagataatggggaatggagatgcccctggtgcttgtggcaaaggtcttggttcccacgtgtatgccatcgagtactggaatggaaatctgaacctcagctattgtctctgcttctacccagatggggtgactgctccccagatttaccgagcagcagcggcccctcccgtcacagcacaccttcctcttggtggccctagagagctgtagctcacatgctgctcaccaggtcactcagggcacgtagccttgggatatcgggtgtcttcagtgcctcacagtgtcgttacaggtcatgcggtcaccccagaggagaccgttacagccttcccggctactgtatattcactgatgggaacggtcctatgtcctttgaagggagcagggcgtgtggccaccatgtctggcctccttcatagcactgtgttttgtggcctcttctgttgtagggcgagggtcagggccccgtggctgggatggcagcccccttccttgccttgtgttttctctcagcatctgtctgcgggtgtctgtgggactttagtttgccagcttctctgtggtgcgtcatttctcctgagaatggttcagctcaacgtagggttagtggggacgccttgttttgtttttgatgtttcgtaagtaagactcactgtgtagcccaggttggccttgaacttacagagtcttcctgcccagggatgacaggtgccatgccaccccacccaaccttggcatgaccttccgcagagcttttcaaagcctgtatagtattttacttcaatttaagtttaccaaattgggtcataagaatggctaaggcgggggttggggatttagctcagtggtagagcgcttacctaggaagcgcaaggccctgggttcggtccccagctccaaaaaaaaagaaccaaaaaaaaacaaaacaaaaaacaaaaagaatggaagggagagaaatggctaggggagggcggggcagatggagcatggaccacaggagatctgatgagaatgacaacagcagaatctctgccacgggtgtgggggacaggtgggacaggagagatagaggagtcgggtggcctatccttcctgccaccctccccactccacgccacccccgcttgcctcaggcaacttaagcaggcgtcaccctgtctgtctgctctccctgcttggctgagcgtgtggcagatgcgggcagcgggctgctacccgcagggcctgttgcacgcatatttctgctgcagccgagtctgccctccgtctgctgcaggaggcatgtgcccttctgctgtgtcccttatggcccactgtcaggagttctcaccccaaaggctgaagttccaggttacgtggctcgccgtgccttggagcaggatggtctcagtacccagggtttacacaacccatgttgttttccagaaacttccgagatttctcccctgtccaaattctagggctgtacccatagctcagcccccaatcattgaggtcatgaaacctgcccatcccccaggacaggactgagcacagagacatatagtagagacatccgcccgtcccagggcccagcctgctcttactctgggtttgagacaaaaataatctccaaggaatctctcagtgtctctccaccctgatccggttgagttcgtgtccttccagccactccctgagggcctgcatggcctaggcgcccagttaggtcttttcagctgtcttctttgccctgaggccatcttggagcagtggattgtgtgggccagaggagtgctgctacccagcagagtgtgttggctggggccgtggactctgctaagggcctccctggcgggccccaccgtccagggctcagaggagaagccatggaggcaggactgccccagcccccttttccaggaaggtcctccaagagcctgtggctgatgctccagcctgacctgacgcttgtccctccccaggctgctgtcaccaaggcccagcctcctcaccccagccggagatccccgggccagtacctcgccccagaagccgctggacctgaagcagctgaagcagcgagcagcagccatcccccctattgtgagtgaaccctgcatccaggcagcccgccttgattgaggctcatcactgctggttggagctttgcctgcagagggaggcttatccccaggccggtggcttccagagatagcgatgtgtaccgaggactggtgatagataggcagtcctgggaggagttgggagattggaacagaaaggctggtctgagcagtagctctccagagttcccccacgccccagacccggcagctgtggccagtgagcccccagacccagcgacacctcagccagcttaatgtccaggcccttgcaggtctgtctttggggccgttgggagctccctgttttctggacactcggctggctgtagtcgcttcagtccttttgacacttagctttggcctttacattcatgtgttggacatggtgtgtccggcctcgctgctagcaccccaaagcccacatagcttcttactcctgattcctagtggtgtggggtgtgccgggtggagtgggaattagcggatcctagcacccacctggctctgggcctcagaagcaggcccttctttggcggggatgacctccgctccctatatctgatgttgaggctctgcctccattgggggttttaaatgggatgtggctgcctttctatacctggcttttgtgctggccacacggcccctccccaacctgtcaacctctgatgtggggccaggatgtttgacatggggccagaatgttcatgcctgccccatgccccccagcaggtcaccaaggtccatgaacccccccgggaggacacagtacccccaaagccagctccccctgtgcctccacccacgcagcacctacagccagagggtgacgtgtctcagcagtcgggaggaagtccacgtggcaagtgccgcagcccggtgcctcccgccgagaaagagggtgagtgctgggcacagggatgcagtcagagtgaagggcagccctcttctctggagcttccagtggcagctggccaggctgggaggacacatagttaaggcagcagcagatgacaggctcagccatagagctccagaagcagctcgagctgggggctcttgagaaaccagaggcaatctaatgttggggtgtgtgcgtctgtctgtgaacgtgcgtgcaaacatacatctagccagcttctcctttggtgtgaatcaggtctcgtgtgacctttgggctccctgaggttgcagtacaggtctctgtcttagaacgacagcaggactgacctgagctggactggctcacctttccctggctaaggcatggctgcccatgttgacaccccttccttgtcagcacagagcctcttgtgcaggtagagggcagcgtctaccagggccccgtggaattttcacattggtgcttctgagcaccagggttcctcctaagctagtggtggcaggcatgagaagaaacaaatggtttggggcgggtgcagggccaacataagtgggctggatattcaacaaggatctggtgaggagagggtaggggatgatggggaaaggcccttcagggactgggaatgggagaggaggtcagagagggaaatggggacgaaattgtgtagctgaggtagagactagctttgagtgaccgtttgctttgggaggggcatgacatcagattagggtcttgggaaaaatccgtttctgattcctgttgagaaagggcagtagggagtagggcaggggtgggaggcaggctgaagtgctcctcccaacagctctagggcagcctggacttgacaggtggccttggaagtgggaggaaggggaggcttgagtttgttcctgaggccaagccagcgggacgtagtgatgacctctgggggatgagggcagggttgtcttgttagagctgggaccggaacacactactgtaaggggtgggctttaaggggccaggtatatagaacacagtatgctgtgagaagccaccgggactcaagatgatagcctgggatgacagtaaggggaagggggaaggctctgatctggctctggccaggcagccgtggctgaacggggctgaagccacccagggccagccaggtcctgctaagttgggccctaggccccagtccctgggaaaagagccagcagtccacagtccctgaggctggttctgggcccatccatgtggccagtgctatgtcggttcctagactcctcccgggggaacattgcacctggcggcgggctctgtcattcacgtggtctggccacagttctgctccccaggggacacatgaacccagcatgcaggaagccagccttttctgtcctggctccaatagggagcttccaggccaggcaggtcccttgggatccccaggcccggctggaggaacaggttgtccgtcctggctctcagccacctgcctgcattggccgagtctgaccccatttccttccagcctgagacttcctctctgccccccagctctccagagccaagctgtatggggcagccaaggtacacagcaggccagggagccaggtgtttgaacttcctggttcagagcaggccctgtaggttgagaatgtgaatgtcacaccggttaactttggttaaccacctccctggggcctaagttcagggggagtttgtgctcccctaagggaaagatgtggagtgtagcactcgggcctctgcttgtgctccagcttttcaggacagcctagggctgcgtggaggtgatccaggagacacttagcgtccgttcctgttccaaggccagggcccttgtccttcacgatttctgggtgggttgtaatccccagaatgtgtctagccaaggctggccacccagaaccgctaaagtgagagcttgtggagcctcagggagtgctagcctcacacaggggatctgggccatgtggcgcagccacaagcctaggccagggctctagcctgtgttctcaggtctcccctgcactcagcagctggggcctcggtcttcccatctggagggtgaaggaacaaactgtgacatcccacagagtgctaccctttgctgttgtttgtggtcacatgggctccaatccaggcaactgacccaagagacctcatcaaacgggtctgattactgtcctcagtgtgcacccacacgggcccatcaaggcccggctggaactcagcctagtgactggtacatagtagacggctagcacacggactgccgctgccccaccctcatctggagtagctgccgtagccacatcccttgccatagaccacagtcacggaggtcagcaagcctgacccagcactcttggtcctggacacccaattggtgacattccgtgggagaccgtgaagcaaagattagccctctgacacatgccctctgtcatgcctgtccctgtgggctcagccacaaggcagccccataccaagcagttatcatgggaacatagcacacctttgctgacatgtcccaatggcccctcatgtcaggatactgtcatagctgaccagtggagatgtcagagccctccctgactgcccaacttaatcctctttcagcagagaaagcttcattctttcccgccttcccagctgagggcccgaagcttcctactgagcccccacgctggacatcgggtctgccttttcccattcctcctcgggaagtgatcaagacttccccacacgctgcagacccctctgccttctcctacacaccccctggtgagtgggcaccaccccgattaggtctctgcagtcagtgggcagtcggctcttggcactggcgcagggctgcatggtgctggttgggtgagatgagaccttgcctggaggtttggcgaagctgggcacctcctgagaacatctacacacaccctgtagtggcctaggcagccatgggagggaaagagcagcaagggagatactttccaccggtgactaagaggacggtcgttagagggaggggacggcagtcttgatagtttcaggaaagccacctaggttttctattcttgatggtcctcaccaccagtaaaagtaatccagccaggggccaccggcaatggcaatgtcagcagtgggtggcctaggtacagctgaccctgagggacatgtgcactgtttgctggagcttggagaacagagaaaggcattcccggcagaaggaacagcgtgtgcaaagggcccaaaacaacaggagttgggacacttgaggcaccaggtcaaactgtcacagcagaaaattactacccagccagcccagggatccccagtcacgtgccactgaaatccatgccggaggtgactctccctaaggcggggggggggggggtattgtaggctcacagttagggagaggttggcctactgactctgggaaagatcccttcggaccctgggaggagaacagaatctagggagggggtagaagtggggtgctggcttagaggcctgagtgtggatcaagaggtgatggtgcagccgtggaggatccaggactggggttcttgtggagggctcaggtcattgaagcagaggtatatagaggagccccccacagtatacacttcctgtttccttgcaggtcaccctctgcctctgggcctccacgatagtgcccggccggtcctgccacgtccccccatctctaaccccccacccctcatctcctctgccaagcaccctggtgtacttgagaggcagctgggtaccatctcccaggtgagtacctcttgggctgggtctccccttcacgggagcctttctgagccgtgggatgttgccaggggtggtgctggctggactcagccctgctgctgtgggctacgtgtgtcacaggccgtgtgttccagtgccttaggcaggtgactcactgtctgtaggcttcagttcatcctctgttcagtgggagggtggggagctgcagctgctgcaggctgtagagtgtcatgtctgtcgtaagccctcggtcacctctgcatcctactgacagtcaccaactcaccacatggtttgcaaagcagtcacactgtcctttctgtagacactggccttgggctgttgttggcctggccacagtcctccagtcgagggccggcagccccgtctctcacttgcgtatccttaagtcctaagcaaggctcttcctgtgtctgaatctggtcttcccgtggctgagtctggttgtgatctatctcttcgccctagcagggaatgtcagtgcagcttcgcgtgccccactcagagcatgccaaggcccccatgggccctctcaccatgggactgcctctcgctgtggaccctaagaagctgggtgagtgcccatgaccttttggttcctatgcccggggggcagtcttggccctgggaacctagagggggggcagcctgagacctctgtgtaccctctcgcccacccctagcccccttcagtggagtgaagcaggagcagttgtcccctcggggtcaggctgggccacctgaaagtctgggagtgcctactgctcaggagacctctgtgctaagaggtaagtctggcccagtcaccttcagtcttagagagcctgaaagcccacttgacagttgtctccttacccttgactccacaggagaccgctaggtggcttttagacttggtctaaagagctgtgtcttatgccttctagggacagcactgggctccactgccagtggaagcatcaccaagggcctccccagtacccggactgcagatggccccagctaccgaggctctatcacccacgtaggtgctgggggcagggtgggatgggcaggcatcctaggagggttgggatgggatgagaggacctccggggagacgagagatcttgagctgaatggttggtcactgcggtgtggggtcaggcctagggtgatgaagaaaacaggtgtcatgtgtctccagcagttgggtgtggcagagaccaaccacagaaaggatagccaggcccctaaccagactgtcaggagccatagatcataaagtgtctggactgagaaagttaccaggtgaccccagtgacatgttgccatggccagaagaagcagaggggacagaggtggcagctggctcttgacaaatcaccagtcggtaggcatgagccagtggtgggtaccaggcttagtacccacggtgtgtggccaagcatacagcccagcgaacttccagtcacgggaccacccaccacagggtccttttgactcactgtaggggacaaatgtccattcatgccgcaggcttcccctgaagtctctggaaatcttgggctttcaaaggcaaagctcagaagctggaggcgaaaattcagtcatgtccttctggcagtgccagtagccctccctgactcagttttccctgtgacagaaatgttctttccaggataggtactccaaggagctcttagagtgccaggtttgcacacagagcttcgcagggctcagggatgccggctcacaggctgagaatccctttcccctggttagggcttgtggagagtgaggtcagcgctctggggcctatctgtgtgggatgatgacccaggcattgatgtgacacggctaacaggtggagaccacacatcccactgttgcctgaccgccctggaacccaaggccacagagccccatgtcccactcagctcccaggattacactcaggccttggagcgggctgcgggtgggcccctgtggctccctgtattctttggttttgtccagtgagttatacggagcagaaccatggcctggctgtatttcggttgtcagaggcccctctaagcttggagactcaaaacatcaatacccccttttcatctggagcctgcctgacctttctcaccgtatacctggcctagcaagcagctaccagccacttgagaaggcatttcccgacacacccagaaatcaccccgcatgccccacggggaccacccaacagaacaagtcccacgggagacaaacatcactgaatctgttcctgaggtcataaatgaagagagaactcaggatttgggggcctctgagagccaagttagagtcctcataggatggatacgtgctgactaattctcaggaaagcagggtgacttgttattaacagcagttagcaacttggggtgatcctaccttttatcccccatgggctgtctcagaagctgtactaatggccacactccggttcacagaggtcacctaagtggatacaatcccacaaaaccgcatgccgttggtttgagaactcctggggtggggagcttactccctctaaatcagtgtttcttagttggcccgacctgccccagggacatcagggggcatttaagggtgtgtttggtggttatagtggacagaggtggaagggcgtgagtcacctagtgattccagaccaggaagaggtgcctggctgctctctacctcagtttccctgtggtttggtggctcgggacagcagtcccagctcttggaaggctcaggcaggaaggaggctggtgagttccaggctaacctgagctatattgccagagaccttgtctctatggaacagtattcccgatagcgtctctgggagggtacaagtgagagacagggtgttggcagcagtgctgacactgggaagccaggatgagtgacggtggcaatggtgcggggggaagttacacatgcatggctgtgtataccttgtggggtgggggagtaggtgatgtgtcaggagtcacccactctacccctatagggcacgccagcagacgtcctctacaagggtaccatcagcaggatcgttggtgaggacagcccaagtcgccttgatcgggcacgagaggataccctgcccaagggccatgtcatctatgagggcaagaaaggccatgtcctatcctatgaaggtgggtacagaggacagagaccatgaggcactggcagtcaggtggggtggctcctgctgtcccctttctttccattctaaggatgtcttttctcaagacagacatagcaagactcctgagagcaatccccttgctaggctggggctcagcagggacatgtcagacagtacctccctgccaggtcaggttgcccctgcaaggagtgtgttggaaaccccttgttgataaggagtcaggaaaaccagactgtaacatgtgtccccagacagcagttgtggtgtctatacactttgctgagaggggaaggtcctttggcagagcagaaagcagccaggggcctttgggttggtgttgtggtagcctcaacaggttgaggactgggcctaggccctgcctgccaccttagacatagggaaacggggagatggacatagtcacattcagtgcccttctatgagggtaccatcctggccctggttagacaaggcaacccttgttagggaggaagccatgggatctataaaaggtgtctttagagcaaggcagagctgaagggacaccagggagcaggcaaggagtgacttcctgtcctgcaggcatacagcccagaaggggtcagggctggccttggtggcttcccctacagaggctgggaagctggggaaatctttgagtgccgtgacaggaaagggctgtggtagagccatgacacccttctctctggctagaaaaggagccagggctgcctaaaagttgaggaacccatacctgggatgcgtctcccagtacccaagcacccacatcaacactgctgccatgactactgcaggcctgggggctgccagcttccctattccttgagtctcacagccccctggtcctagaggtcacaagtggccccatgggctttggcacctgacaataaagtacagtcttaaggacaagggctacagctgaccccggtgctggctgcatgtccaggtgacagacccaagagcaaggagagcgggtgatcagaggtcctggccagagccctgagtcacggagtgggagcctctagagtctcaggttgtaactttacagcctatcttggtggagactgggtatcctgttcgtctctttggggcccagtgggtctgaagcagttcagagtagcgcccaccgtcaggcccagccccagctgccagccctttcttcgcaatctcccatagccagagcatccaagtcattggggatagcaatgccactctgtccccgacacgctgaggcttcacatggtccttggacccggtgctcacacatcccttgtgtacatgcagacctgcaggcgcttgtgggggctgctctgcggactcagaccgtgctgacatcttcgttagtgtgcacatacacccatgggcacagacacacatacacccccctacacagcagtggcaggcatgcctggcactttctgccaagagcagttcccagttgagctggtttgagggtcccatctgtgggggcagggcctcctttcagctctgcctgtttgcctaactccatgcctgtggtgtctgcaccttgctgccaccccacaccatgtgctttttctggccctcaggtggtatgtcggtgtcacagtgctccaaggaggatgggaggagcagctcaggcccaccccacgagactgccgcccctaaacgcacctatgacatgatggagggccgtgtgggcaggaccatcacctcagccagcatcgagggtaagtgtctcactgtagtagcttaccggggtcaagcaccatcccaggagaccccaggtacccaggtaagaatggaaagggagggtggccccttgacatgcctggagggagccagtcagtagttggctcaatattaacaagtagagaaactgaggcacaacccggtgcaaaatgcagcccagggaaacggggcacttgcttgctgggtgttaagtcacaacagagactgttggtggtagagcccagccctcctggacaccatacggtgacactatccctgctctccccaggactcatgggccgtgccatccctgagcagcacagcccccacctcaaggagcaacatcacatccgaggctccatcacgcaaggtatatcctccttacggtgtgtaattccacctccacgccaaaaccagctaaggggttggaaaccgagggtgaacttcccgtccgtgtcttataggtggagtgactactctgtacttggcgctcattccaaagcccatgctgcatgccttgctagtgattgagagggggtccagattgaatgtgtctttagctcatgcctttgtggtaaactgagcaatgtggtttcacttagcgtcctcacgtcatatgaagaaacaggcttagaaaagtcagtttgcatacccaaggtcccacaggaaggatttgtgctgacccaggctgagccaggcaaggcagtggagagccaatgatgtttgcccggcaggcatcccgaggtcatatgtggaggcccaggaggactacttacgtagggaggccaagctcttgaagcgagaaggcacgccaccgcccccaccgccacctcgggacctgactgagacctacaagacccggcccctcgaccctctgggtcccctgaagctgaagccaactcatgagggtgtggtagcgactgtgaaggaggcgggccgctctatccatgagatcccacgagaggagctgcgccgcacgcccgagctgcccctggcaccacggcctctgaaggagggttccatcacccaggtacgaggagcacaaaggaggggccggggcttgggcaagcctgagggagttctaatgctgccctcattgcattgggttataaactaaggcccagagaggtcagcggcttgctctggtcactgacagggcttgtgaaaccaaagtcttttggtcacttggctgctccccacattgctacctgcatgttgtgtgtcaagactagagccactgtcccctaccttggtcatggcttgatggaaaagaaagacaaaacagccagacaaggcacctagggaaggctgtctgtcacctgagccagggacacacagtgatggaccagaatgattctagggtattcttttgaaaacttaggtgctgctcctcatttgggcccagcacttgggaggcggagtcaggaagattgtaaatttgaggctagcctaggctacaaagctgtactctggcttactgccgatcaccaaagttttacaatttaatgacaacacaaacattgagtgaaattgagatctgggacctagctgtgctcactgtccccagcctggatccctgtgggatcctctccaagatgtccaataattcccgtctccgtggtgtcctctgagagccaacaggaaatgtgtaactccagcctgggacccggagccagagctggggtgacagcagatgcatctgatatggagtccatagtgctgcaggatgtcgggggccacactgggtgaggaaggtcgaattgacctgtagttagccacgctctcgtacccctccaccagtgggggtctctggacgtatagccaggctgaagcgagcagggtatctagcctctgacgtctgtcttgctcaaggggttagagatgccccatcctgtgcagacatacagggagaacagcatctggccagccacatacagacctggaccctctccccaggggaccccactcaagtacgactccggggtgccctccagtggctccaagaaacacgacgtacgctccatcatcggcagccccggccggccttttcctgccctgcacccactggacataatggctgatgcccgggcactagagcgcgcctgctatgaagagagtctgaagagccggtcagggaccagcagtggtgcagggggctccatcacacgcggggccccagttgtcgtgcctgagctaggcaagccccggcaaagcccactggcctacgaggaccacggggcacccttcaccagccacctgccccgaggctcacctgtgactaccagggagcccacgccacgccttcaggaaggtgaggctcccctgggctgccagctgtggggaggggacagctcattttccaccgccagtctgtctgctgccctgcctccacactgcatacagagccccccgtcgttcccccttaccaaatatttttaaataattcaaatcagggctgaggagagggctcagtagctaaagtcttgctgtaccagcatgagactcagagttcaaatccccggtacccacataagccaggcacactcatacacatctgtaattctcatgcttcacagtgagacaaaggctaagacagaaatctcctaaaggttataggccatgagtccgggtctcaaacatggcggaaagtggatgacacctctccccccccccctctattttatacacacgcatacgcacactcatatcacagcacactcgcgcctacattcctgtgcacacatgtacacacaaaaacaatagtttaaatgaagcagttcccactctgtaggcttcacctctccagtagcgctgctggtctgaagcacctgcctgtgacgtgaccgccgcatcctactctgaatccgcttctgattctctcgcatttctgacctccgctctttctccgatcctcccacatgtgcagcctttccgtgtgctggccctctatgccgaaggctccacctttggttttgcttctagccaaccactgtataccccacgtcaccagatgtcagggcctggagaggctataggcacctccaactagttccagccacatccgggccgggattgtgttagggtgtcagaccagtgttttaattcattgtatgagggagcccttcccagagcactgagatcctcaaacatctctctctctcaggcccgtgcacttcctaccttgggttcatctcctatctggaacaatggctccttggagctcagggttcttgcctgctttcctctcagggtgctccctcttctcctcatgggaactgccagcccatgatttaagtcagactggaatgaatagggcaatggtgactggggagtaaatgaatgctttcacaaggagccaggagcagagagacaagaggctctagggcttgtgacagctcagcctggtggccccgttgaggctgaggccactttgacctgtccccacaggcagcctcctctccagcaaggcgtcccaggaccggaagctgacctcgacaccccgggagattgccaagtccccacatagcactgtgcccgagcaccacccccaccccatctccccctacgagcacctgctccggggtgtgactggtgtggacctgtaccgtggccacatcccattggcctttgaccccacctccataccccgagggatccctctggaagcaggtgggtgcctgggcctgtacatgtggggcttattgattgtgcttccttgggtggacacttggggtatggcttagtgctgccatcaccagctgcttaccccagggcaggttctaggatttgggcttttgtcggtgtttctcaccgtaggactcatctgtcccttgcaagtgcagtaaatgaggggctgcagtgagtgccatgatgtggaacctttttaaaggctcctttgtgaaggtgttagcacctgtatttcgatgcattatattggggggcacttccgaaaacattaaaagcaggccccccacatgatgagggagcgagtcttaagctctgtgtgtgcattggggaggcatgtgggtgtacaaggagaggaagctgttgtggcagaagtgaggaacgtgaagataagtcatgggccacctgaccctccatccctccctccctccccagcagccgcagcctactacctgccccggcacttggcccccagccccacctacccacacctgtacccgccttacctcatccgcggctaccctgacaccgcggccctggagaaccgccagaccatcatcaatgactacatcacctcgcagcagatgcaccacaacgcagcctctgccatggcccagcgcgccgatatgctgaggggtctgtcaccgagagagtcctcgctggccctcaattatgccgctggcccgcgtggtgagttgcctggggctgtgcccatcagcagagacttgtcctgcgctgtggtgtgcaaaagaagagtgcacacgtgtgcactgcagctgggcggaggggcacagttggctgggaggactaggtggtgcatgctggctccttgggggaagggcagacggggccacttgtatctgttcacatctagaactgtgcttagcagacactcttgccaccatgcaccgtgggtctttgcgtgttgttctgaaaccttggtatggggcatcttctgtcatccaagagatcaaaatacaggctggatgtggcattgcacgcctatatcttaagtacgaggaaggtgcaaggccagcctcagctacataaattttgaggccagcctgggctatatgagtctgcctctatacaaatgactgaaaagaaaggaatgagagcatgcggcttgtcagaacactgacttcctgtgaacagcctgggtcactttgcctcgactgttcagagataaccttgtggccccagttagtgatacggaagccactctgggggttttagaggatgggagcccaatgcaaggagctgatactgtgggaaggcagtgtttggggtcaaaagatgttgtttgagagacactgcacgtcatagccttgagaaaggggcctggggccactcctggcacccaggaggggtagtgcaggtgaaaggtctcaggcctgcacccttggggacaggacatcaggcacctacagctgacatcccacccccacccctgcaggcattatcgacctgtcccaagtgccacacctgcccgtgctggtgccgccaactccaggcacccctgccaccgccatcgaccgccttgcctacctccccactgcgcccccacccttcagcagccgtcacagcagttcaccactgtccccaggtgcgcctgccaaatggctgggtggggtctgtgcctcaccccctgtgccctgcaggtaagttctggcccactgggctctggctcacactctggccttggggtttccaggaggccccactcacctagctaaaccaactgccacgtcatcatcggagcgggaacgggaacgagagcgagaacgagacaagtccatcctcacgtccaccactacagtggagcatgcacccatctggagacctggtagggcaccccagaccccgccccacccccaggtcctcatgggccacctgggcctgccccctgactcggcggcctgtcaccaggtacggagcagagcagcggggctgggggcagcagccgccccgcctcccacacccaccagcactcgcccatctccccccggacccaggacgccttgcagcagaggcccagtgtgctgcacaacacgagcatgaagggcgtggtcacctccgtggaacccggcacgcccacggtcctgaggtgggccaggttggcaccagggggaacaagcctggggggagggtacacagatggatttgctgagagggaggggtgtgggggtgggcagatgggtagggaatggagcagatggcaggatcggaaggtgggaaagtgagagagactatgagagtggggatgggtggcttgtcagccgggggaggatggcccaggggagagggcacacagtgagtggacgggagatagatgcagataaccaggcagatgacagtgggtggataaaggatggatggatggatggatggatggatggatggatgggtgggtgggtggatggatggatggatggatgggcagacagatggacgagtggatggatggactaatggatggatggacagacagacagacaggcagacagacagatgaacgagtggatggatggactggcggatggatggacggacggacggatggatggatggacaggcagacagacaggcagacagacagatgaacgagtggatggatggactggcggatggatggacggacggatggatggatggacaggcagacagatggacgagtggatggatggactgatggatgaatagacagacggacgcatatatgagtagacagcaagttgatgggcggcggatgaatgggtggattggataggtggatgagtggatgaacagctggatagacaggtagacagacacagatgaatggtggatgacggcagctggatggtacatgtgtcagtgggtagatggataagtaggtcgacctgtataggaagggggggtggggtgactgggtggatggatacggacggatacgtggatgtgtccatgggtgggagggagggtaggcagatgtgtggttgggtggctgggcagtcggatggatggatggacggatggacagacagacagacaaatggacagaatgcaggtggtgggtgatgggataggtgcaggagtcagtcggtagtccctagtgtaaagggaacagagagcttaatgtgtggccacagggctgatgttgcccatagctgcccacagtgctcgtattgggatgccgggcttctgcctgaagtcggtcctgtgcttcctggctcacgcgctcctcacttctgagagggcccgcattccaccttctgggagtgcctcctactggccctgcttgagcttcctgccttccactcagcatgcttatatctacatggtcatgtagcagtggatgccctcagacgaggatggctgcctctgttgctgtcatctcagaagctccggcacccttgccttaattaccaaattctgatcatctgggagggtgcttggcacctggtagggactcagtaaaaagcttttgggccaagcacagcttaggtcagtcaggagagcacttattctgggagcctcagggagtgaaagtctaggtaggaacatggagggtgtgaggtaggaattcattggccagcactgcctgaacctttctctttcttttcaggtccacctccacctcttcacctgtccgcccagctgccacattcccacctgccacccactgcccacttggtggcaccctcgaaggggtctaccctaccctcatggagccagtcctgttacccaaggagacctctcgggttacccggcctgagcggccccgtgtggacgctggccatgccttcctcaccaagcccccagcccgggagcctgcctcctcacccagcaagagctccgaaccccgatccctagcaccccccagctccagccacacagccatcgcccgcaccccagcaaagagccttgcaccccaccatgccagtccggacctgccggcgcccacctcggcctcagatctgcaccgagaaaagactcaaagtaaacccttttccatccaggaattggaactccgttctctgggtaagaccaccctgacagcggccacgttcatagacgcaataatcacgcgtcaaattgctcacgaaagggggccgcgagaaggaggttcgctggccatcgactcccctggcgacggtaagacacccggcccgccgcctgcccaccccatctgtggcctaaagatattttcagatctttgcttttaattttttcccccttttttggttggttttggtatttcgttttgagctcgccatcctcgtcagtcggcacgctgtggtgactccgcccacacgggcccctcattcgcccatccttcatcatgagtttttttttttttccttttttctttttctttttttttttttctccttttttctttttggatttttcgccttttttcctttaatgaatggatctgtggtttggactccgaccgcgcctcccatctcccgccaccaccacctgcaccttcgttttggggagtggggatgcagggtctaccagttgactgtgccaccactgtacatggaggaagttaaggcagggagtgaggtggggggaaggctgggtacccacctcctcttcccacaccagctacagccagccctaagggaatgaagcctcccggctggatcagagacagtgggactggggccaaggctggacctagggacccattgtcactcagcttgagcctcacaccaccacaccctgaccccatgcacattcacaccctccctccagtttctccaccaccacctcccagtctcccctatctgagccccacaccgcccaagtcagactcccataatcctttgggtgtgtctgagtcctcataaatggagctcccttcacttgcagagcttcctctctggccacccctaggtcgacctgattttcttccatcttgaggcccagactgtggaggaatggctcctcccaagcccaccccacattctgaccctagctcacctgtctcaggttaccacagtggagctggctacagccctgatggggtagagcccatcagccccgtgagctcgcccagcctgacccacgacaaggggctctccaagcctctggaagagctagagaagagccacttggagggggagctgcggcacaagcagccaggtgacacccgggagagtagcaggtggggaaactgaggcacggctccatgttgtcctcaggcccctgacaagctctgcttgtgtcctcaggccccatgaagctcagtggggaggctgcccacctcccacatctgcggccactgccggagagccagccctcatccagcccactcctccagactgccccaggcatcaaaggtcaccagagggtggtcaccttggctcagcacatcagtgtaagtgcccatctctggcccctgccattgggaaggcaggtggctatgacagccatatcccacagccagacagatgctaacatgcttaactggccaccacgcttagtcctttgggggtcatcataaggtctaaccagggacacttacccaggagaccaagagccagatcagggttctgccctacctactctgaaagtcctgaactgccctctccctgcaggaggtcattacacaggactacacacgccaccacccacagcagctcagtggcccccttcccgcccctctctactccttccctggagccagctgccctgtcctggatctccgccgtccacccagtgacctctacctcccacccccggaccatggcaccccagcccggggatccccccacagtgaagggggcaaaaggtgaggaagtacccatgtctgcatcaggtgctgggaacagtgggacaggggtgagctttgcagtgtggggctgatgggaaactgaggtgcagggatacaaagcctcactacgctcccagaacagacacaaagcatctaatcaagaaggtggctcacccaagggtcccacgtgccaattgaatgtcctatatataccaactcagctaggggtcagatgtcccacttccatttagcagatagggaaactgaggcatagagaggtgagttactatcccgtcccatgcacacaaacaccctgcacagatgtagacaggtatctctgggtaacagcgaggtcctagcatgggggcctcatcagggcttacaacatggctccaagcaccccagcagcactgtgtggtggcataccctctggacaggctgaggcaagacgactgtgaactgcagggcagcctgggctgtaccacaagaccctgactcaaaaataaaccaaagcccatgagtgttgggtcagttcgaaaggtctcagaagccccctggggtctccatacctcagatgcagagtctggccattcacagggaaacacgtgagccccactgtgggcagtagggggtcatcttcatggagtagaaccccactctcagctgggatgctgtctccattaggtctccagaacccagcaaaacagtcctgagtagcagcgaggatgctattgaacctgtgtccccaccggagggcatgactgagccaggacatgcacggagcactgcgtacccactgctgtaccgggacggggagcagggggagcccaggtagctatggcacaaatccccgcttagaggtggtggtgttggttccccatacacccgtggcctcagccctctagcgtggaggtcgtcaatctcttcacagctcagcgggctgatgactttcagggggcttcagtggtggcaccctgtgcctggcatctcagcccgagtcatgtcctatttatcacttgctgctgattgagaatgaactaaacgggaccagagtgggtaggggtgggcatggacctcagggagggtatgacctatggcggcccagtccctgggaattcttgtgtccagtatagctctaagaagttctcagggggaattcacagtgtgcctgggaggctcacaaaccgccctaagccagggctaagtacagatcccagcaggcctgggatgggaaatggttggtccttagcacctcactgtggctcaagtggtgagctagccccctgttgctaaacacagtgcccagcctgctgaccctggcctctcatgctccctgcaggatgggttctaagtctccaggcaacaccagccagccgccagccttcttcagtaagctgaccgagagcaactccgccatggtgaagtcgaagaagcaggagatcaacaagaaactcaacacccataaccggaatgagcctgaatacagtaaggagaagccaaggccagagcaggcactgggagacagagtgctcttaagccttcctgtcgaagggcctgatagtctgccagtggataccgacggcatatagcacctcagtaatgccctacgcacagtaggtgctcagcgaaacctatagagacagccctgtgctgggcgcgaggagcacagtgcactactccaggttcatgctgcaggcatggcgcctttctccacagctgatgtgggtggacaaggacccttgtccttagctcagggtcgcagggaccatatgcttatgagaatgcactgggaaacaacacttgagggcttcgcactgtcccctcccaccagcagcccctccctagggtggcttggacaaatcctttctggagttagactacagaagcccttgcaggttagcacaggcctagggtagtgacctactgccagagtaaacctggagcatcagatacctagttgtgccagacattcaacccagaccgtacagggagctaacgggtgcagatctcccagaacctgtgagctcaggccttacccaccttgttaccctgctctagatatcggccagcctgggacggaaatcttcaacatgcccgccatcactggagcaggtaaccctcccgtgtgtccgcatagcaatctcccttccccaactactgacttagtgacaaggagccttagccagttcaaatttgagccctctccctggccttagtggacccagaatggcacagcaggccagcctccactgcctcgagtcctccctacatgagggacgtccaaggtttgagatgagggttttctccggtgggtgttaggtacaccctggtaatacttgcccaattgctggggctgaggcacgtcacccagtgtgggcctaggaaattggccttggggtccagagcttcagggtgccacaggcatctctcacactacaatctccatttggggttccagcagagagccctggcctttttctaaatcagatgcaaacgggtaatgtgagagaaacatgtcacactcaggtgcagtttgtggcagaaatttcaggcattcagtgtggtgcttgggactcagaacatcggcttgccatggttatgatgacgttgcccctgggaaagaagctgtcatgggaataaatggctcaggaacacctgagccgggactgtgacactggggcagctgtgaggacttgcactccaggctggaggaacaggcaagggttcactaccttccttatgtgtggagctttgggcccagggaataaggtggccagatacacccttgggaacatttccagaggaccacaggacctgcagagggggtgggggtgggatcctggcaggggctgtcacaaacccagaaacatactggggacttttctgagcctcgggcagaaggaaactttgacaagttgaagatgaatgtttctagaatgttctaaatcttgatgaggttctagacacctgggtgtgtgtgcaggtagagattcacagggtaatacacgcacacacacacacacacgtgtgcctcctcaaacaccccccataaatgttagtcctcaaagtcatgtttccaggcatggccaatgacactcaacatcgggccagaggtaaatgaggaaggtcatgcctgtgcccagtgagcgccctcaggtcacaaggcccaggagcggtcagtgctccatcaggaaactcccctccacccctctttccctgttacctcgtcgtatctccctctgtattctggatgtggaggagtgggtggggcttgtttatttgaggttaggggcgtggagggtgtgtgtgtgtgcgtgcgtgcgtgcgtggctgtggcatgcatttacccctgtcagaagttcggctttttcttggtaacatttgcttagcactgagggaacgtgagcatccctgacccgagcttgcccgaaacccaaactgaggctccacagccaccccagaacaggattaggaagtgactgtcccttccatcctcagaagcctggctattttacattgcccgcatttcagccatgtgattttcacaaggtttggtagcctggaggttcacggggcaccagaaactggccagtggcataggctgggaatcctgccgatgacgtcgttgtctgtgtttttgttggtggtggtgatttggggtttttattgttgtgtgttttgtttcatttgtttggttttggggggtggttgatgaggtttagcttggcagtgtttggttcttgcggcctgggtttggagcagttttgtgggtacttgggattgaggcaagacccttgcactcactaagcaagtgtcctccctgtggtgagctacagcccagccctcctctgccgagagaaggtctcctcagctgcccaggccggcacagattggactgaactcactgtagactaagctagccccaagcttgctatgctcctgccgtagcctcataaatagctgggtttccaggcctcctaatgaggctccagccctcgggaggttctggaagcatccactgaaaagagatgcctccccaccctggcatttgcagaaagtcccagagcacaattcatgagagggagagaaaggaaaccggagaggctttgcagaggctcagtgcaggctgcaaacatctcttgaggccagtgtgttgatttgactactctgtccttgtcatggggttgggccagccagggctggagtggcccttcacctgttaagcgctaccctgtccttgcacgcacataactgcatggctgtgacccccccatcccttgtacccagctctacctttctctggctcctgtggggagaaatggggtggaggggggcgagcctagctaagggggaaatcaggcaggctgaggtccctaacccctgagaaaaggggaacaacagggggtcctctctggtcacctttcgtccccacatcccttcctagaacctactcaccagaagaccccggctggacttctatccccgtccctagcacctagctctggcttaactccatagcacagcctgcccctgcctcttcttagacatccacttatagtcaaaatggaataaatagacccagctgcgattggggtgtagagtaggaacagggctggggaccctccggctgccccagacccctccctgcaacagccatgagctgtgggggcagttagggaccccatccgcaccctacacacagaggcgggctggagggacggacgatgctcgcagatgtgtgctcactgtgtctctttctctctcctccctcctcattctatctctcgcaaccctctggctccccggcccccgcccccctgtgtgtctgtctgtctctctcccaggccttatgacctgtagaagccaggcggtgcaagaacacgccagcaccaacatggggctagaggccattattagaaaggcactcatgggtaaatatgatcagtgggaagagcccccgccgctcggcgccaatgcttttaaccctctgaatgccagtgccagtctgcccgctgccgctatgcccataaccactgctgacggacggagtgaccacccactcacctcgccaggtctgcaggcctgcccctgcccacccgcccgcccggctgtgtccctccttaccctggtgttgttaatcctttcacctccccccctcaagcttgggagactgtgaccttatttttgtgcgtgtttgacatctagtttgctaatccaaagctggtctgacaccccatgttgcgaagggcgtccccctcgcccccagcactgctgctttccccgtgctcacaccactccccacatcccaccccttcctcccctgctgtgtggacagggatcaagctgaccaggcccaccatgtgcgaccggggctactgctgggaagagtctagtgtgggcatgaccccttgaaggccaggcagcacgaggccaactccccgttcttccagtgcctgtcagcactctctgttcccaagcaaacacaagcaaagaggtgctctgctgtccccttctagggtcaggccagcctcagggtctggccctatcagcagaggccttcagtctagcacaattgaatgctgtcttgggcaatgtctgtcctccagccaagatctgacactcctcagtgaggggtacagcctggtgggggcagctaagggaatagtcaccaacctctctcatagcagatgttttcctcttttttccacgcctagggctggctctggccatctggtagacctcttagcctcctggctcagggtttctcacactagttttctgtttggggccctaggaggcaggtggctcccccaggcagaatcggccccactgcccctcctccgtgctggtgtgggtgacccacagtcaacaccatctaactcagccctttcccactttgtcccctgcaggtggtggtgggaaagccaaggtttctggcagacccagcagccgaaaagccaagtcgccagcgccaggcctggcacccggagaccgaccaccttctgtctcctcagtacactcggagggcgactgcaatcgccgaacaccactcaccaaccgtgtgtgggaggaccggccctcatctgcaggtgggtatcagctaggggcagagatgtagacatggggttccctgggctacccaggggaggcggtccctggtccccacctagcaaggaagggtgtaggaagccacacattgagagggtcctgtagatctcctcaggccttccagtcagggctggtcacacagggggacagtgcctgtccagcacgtaggattttgacaggaaagcagaaggcagtagaaggaaaagttaccacagccgagtcaaaggtggtagggctgtctagcacagaggcaaagggagaaggccgcttttgagaaactcaaatggtgctggcctaagaggcccaggctcgagcttcctgtgtggtagaatgggtcctgaggtggctacttgcagagccctctccaccactctcccatctttcccacagggtccacgccattcccctacaaccctttgattatgaggctacaggcaggtgtcatggcctccccacccccacctggccttgccgcaggcagcgggcccctagctggtccccaccatgcctgggatgaggagcccaagccactgctgtgttcacagtacgagacactctcggacagcgagtgaccacagattgggggggagcggtgccaggtccctgcacgaggcagaagcagcccagcatggagcagacagctgccaactcccccgactgaggaaggagcccctgaatctgcctgcgcgtccatccgtccgtccgtctactcatctgtccatccagagctggcatcctgcctgtctaaagccttaactaagactcccgccccgggctggccctgcgcagtgaccttacactcaggggatgtttacctggtgctcgagaggggagtggacaggaggggaggccagcgggccgggagaggggtacagtgatcgtgtgtcagttgcacgcgtgcatctggggcagcggggacccaacacaggatgaccaggcacctccatgccactgcctcgccccttaccgcatttggaaccaaagtctaagctgagctcgcggccctgcccctccctctgcccccagcccgctcgcgctctggacagacagacgttcccagcttatcctgccccatcgctgtcatcgcagtccccaaaggccacccagcccacaagactgggagcccatcagaccaggtgggtgcacaaagggccgggtatggcctggggcacggatgtttgcaggaaccggaccgttcattcccggcctgtcgctatggcgatggcggggaaggcaggtgtaaatggtgttggcttacagggtatatttttgataccttcaatgagttaattcagtcgcttcacacaaggaaggactcacccgtgttactgccgctgtgctttggtctctgcttcctgtcccagaggcatgtgccggccaaggcggtggccccaccatacgcaggactggggggcaggggctccggcacacggcactgtgccctccccctcccttccttgggcagaatggacttgatgcgtattctgtggccgctctctgcacggcggcattctgtcatttacacatgttgttccaattaaaaggcaaattatactccagttacaaagattctactctgcttctcactgggcagcaggccaccacaagagtcaagggcagtgttccttaaggtcagcactgagcagtgaacattgaccccagggtacggtgccaccagagggcaacctgtattcacagatgtgaggaagccaccaggtacttgtattgtcgagagcacgctgggtgtttacctgtggggaacacattggctattcatacctggggtcattgtacaggggtgttcacactcgtggggaagccggcaggtgcttgtctgtggtgaccgtgtgggggtgttcacacctgtggagaagctcctgggtattcacacccgtaactggagtacagtcgtttatgcttgtggtgaagggggcaggcattctccacagtgacaatgtgtggtatttacatggtggagaggactgtctcgtactaggcatcagggtccttgcccgaggcttagcctctagggttgttgcttgtgtgtgttaatgtccagcagtcacacccacagtgagggtctcctggatgactcttgcttcttgctgtgccctgtacttatcctgcctgtcgtgttgtgtgggtggtaagtattctccggcctgaccaagatgaccacactggcctctttgggtttgagctaagaaactcagagccttggtgcctgttttagtcagggttctctagagcgagcagtggttctcaacctttctgattctgtgacccctttaatacagttcctcatattgtggtgaccccccccccgaccattttgctactattatgaatcgtagtataaatgtctgataagcaggatagctggtgtgtgtgacccctgttaaaagggttgttcgagcctccaaggggttgcatcccacaggttgagaaagaaccactgctcggaggagtgtgtgtttctgtgtgtgtgtgtcagaatttattaagaataagcgttttaggggttggggatttagctcagcggtagagcgcttgcctaacaagcacaaggccctgggttcggtccccagctctgaaaaaaaaaaaaagaataagcgttttagaagtacttgttttatttttgtttcacgtgtattaatgttaggtctgtgtgtatagctacaccacatacatgcctacagacaccagactggacacagatgactgtgagccaccagcgtaggtgctgggaactgaaccctgggtcgcctggagagcacccgggactcttaaccactgaagcgtcactgcagccccttcagtgagctttaaattagtaacagcagccaggccccacccacgacgctgagaacctgaatgcctcggag

SEQ ID NO: 126 - DNA, 8562 bp, Rattus norvegicus
ctcgagcccgatcggcgccgtagcccggcgccagcgcccggtgccgccgccggtacctgtgacgaggtcaccggccagcagatgaccgagaccagcccctagtcctaggtgtggtcaagagtgtattgggttccaaagccttcctggaccctaccaccatgtcaggatccacacagcctgtggcacagacatggcgggctgctgagccccgctacccaccccatggcatctcctacccggtgcagatagcccggccccacacggacgtggggctgcttgagtaccaacaccaccctcgtgactacacctcacacctgtcacccggctccattatccagccacagaggaggcggccctcactgctatctgagttccagcctggaagtgaacggtctcaggagctccacctgcgccctgagtctcgcaccttcctgcctgaactgggcaagcccgacatagaattcacagagagcaagcgcccacgcctggagctactacctgataccctgctgcgcccggcacccctgctggccactgggcagccaagtgggtctgaagatcttaccaaggaccgcagcctggcaggcaagctggagcccgtgtcacctcccagcccaccacacgctgaccctgagctagagctgacgccatctcggctgtccaaggaggagctgatccagaacatggaccgtgtggaccgtgagatcaccatggtggagcagcagatctccaagctgaagaagaagcagcaacagttggaggaggaggccgccaagccacccgagcccgagaagccggtgtcgccaccacccatagaatcaaagcaccgcagtctggtccagatcatctacgacgagaaccggaagaaagccgaagctgcacaccgcatcctggaagggctggggccccaggtggagctgcctctgtacaaccagccgtccgacacacgccagtaccatgagaacatcaaaataaaccaggcgatgcggaagaagctgatcttgtacttcaagcggaggaaccacgcacgcaagcagtgggagcagcgcttctgccagcgctatgaccagctcatggaggcatgggagaagaaggtggagcgcattgagaacaatccgcggagaagggccaaggagagcaaggtgagggagtactacgagaaacagttcccggagatccgcaagcagcgggagctgcaggagcgcatgcagagcagggtgggccagcgtggcagtgggctctccatgtcggcggcacgcagtgagcatgaggtttctgagatcatcgatggcttgtctgagcaggagaacctggagaagcagatgcgccagctggctgtgatcccgcccatgttgtacgatgcggaccagcagaggatcaagttcatcaacatgaacggactcatggacgaccccatgaaggtgtacaaagaccgccaggttaccaacatgtggagtgagcaggagagggacaccttccgcgagaagttcatgcagcatcccaagaactttggcctgatcgcctcattcctggagagaaagacagtagccgagtgtgtcctctattactacctgaccaagaagaatgagaactacaagagcttggtgaggcgcagctatcggcgccgtggcaagagtcagcagcaacagcagcagcaacagcagcagcagcagcagcagatggcacggagcagccaggaggagaaggaggagaaggagaaggagaaggaagccgacaaggaggaggagaagcaggatgcggagaacgagaaggaagaactcagcaaggagaagacagacgacacttctggagaggacaacgatgagaaagaggctgtggcctccaaaggccgcaaaactgccaacagccaaggccgccgcaaaggccggatcacacgctccatggccaacgaggccaaccatgaggagacggccaccccgcagcaaagttcagagctagcttccatggagatgaacgagagctctcgctggactgaggaagagatggagacagcaaagaaaggcctcctggaacatgggaggaactggtcagccatcgcccgcatggtgggctccaagactgtgtcccagtgtaagaacttttacttcaactacaagaagaggcagaacctggacgaaatccttcagcagcacaagctaaagatggagaaggagaggaatgcccggaggaagaaaaagaagaccccggctgcggcaagtgaggagacagccttcccacctgccgctgaggacgaagagatggaggcgtctggtgcaagtgccaatgaggaagaactggcggaggaggcagaagcctcacaggcctccgggaatgaggttcccagagttggagagtgcagtggcccagctgctgtcaacaacagctctgatactgagagtgtcccatccccgcgcacggaagccaccaaggacgctggtcctaagcctgctagcactgaagcattgcccgctgccacccagccacctgttcctcctccagaagaacccgcaacagtccctgatgagccctgcccagcccctgatgccagtggcccaccatccccagtggcttccccaccacctgccgcacccccggctgctgttgacaaggatgaacaagaccaggctgctactgttccccagaccgaggatgccaaggagcagaagtctgaggccgaggagctggtgattgatgtgggaaagacagaggaacccgaggcccctgaggagccaccagagagtgtaaagagtgatcacaaggaggagactgaggaggagcctgaagacaaagccaagggcccagaggccattgagactgtgtccgaggcgccacttaaggtggaggaggctggaagcaaggcagctgtgaccaagggttccagctcgggtgccacccaggacagtgactccagtgccacctgcagtgccgatgaggtggatgagcccgagggaggtgacaagggcaggctgctgtcaccaaggcccagcctcctcaccccagccggagatccccgggccagtacctcgccccagaagccgctggacctgaagcagctgaagcagcgagcagcagccatcccccctattgtcaccaaggtccatgaacccccccgggaggacacagtacccccaaagccagctccccctgtgcctccacccacgcagcacctacagccagagggtgacgtgtctcagcagtcgggaggaagtccacgtggcaagtgccgcagcccggtgcctcccgccgagaaagaggcagagaaagcttcattctttcccgccttcccagctgagggcccgaagcttcctactgagcccccacgctggacatcgggtctgccttttcccattcctcctcgggaagtgatcaagacttccccacacgctgcagacccctctgccttctcctacacaccccctggtcaccctctgcctctgggcctccacgatagtgcccggccggtcctgccacgtccccccatctctaaccccccacccctcatctcctctgccaagcaccctggtgtacttgagaggcagctgggtaccatctcccagggaatgtcagtgcagcttcgcgtgccccactcagagcatgccaaggcccccatgggccctctcaccatgggactgcctctcgctgtggaccctaagaagctggggacagcactgggctccactgccagtggaagcatcaccaagggcctccccagtacccggactgcagatggccccagctaccgaggctctatcacccacggcacgccagcagacgtcctctacaagggtaccatcagcaggatcgttggtgaggacagcccaagtcgccttgatcgggcacgagaggataccctgcccaagggccatgtcatctatgagggcaagaaaggccatgtcctatcctatgaaggtggtatgtcggtgtcacagtgctccaaggaggatgggaggagcagctcaggcccaccccacgagactgccgcccctaaacgcacctatgacatgatggagggccgtgtgggcaggaccatcacctcagccagcatcgagggactcatgggccgtgccatccctgagcagcacagcccccacctcaaggagcaacatcacatccgaggctccatcacgcaaggcatcccgaggtcatatgtggaggcccaggaggactacttacgtagggaggccaagctcttgaagcgagaaggcacgccaccgcccccaccgccacctcgggacctgactgagacctacaagacccggcccctcgaccctctgggtcccctgaagctgaagccaactcatgagggtgtggtagcgactgtgaaggaggcgggccgctctatccatgagatcccacgagaggagctgcgccgcacgcccgagctgcccctggcaccacggcctctgaaggagggttccatcacccaggggaccccactcaagtacgactccggggtgccctccagtggctccaagaaacacgacgtacgctccatcatcggcagccccggccggccttttcctgccctgcacccactggacataatggctgatgcccgggcactagagcgcgcctgctatgaagagagtctgaagagccggtcagggaccagcagtggtgcagggggctccatcacacgcggggccccagttgtcgtgcctgagctaggcaagccccggcaaagcccactggcctacgaggaccacggggcacccttcaccagccacctgccccgaggctcacctgtgactaccagggagcccacgccacgccttcaggaaggcagcctcctctccagcaaggcgtcccaggaccggaagctgacctcgacaccccgggagattgccaagtccccacatagcactgtgcccgagcaccacccccaccccatctccccctacgagcacctgctccggggtgtgactggtgtggacctgtaccgtggccacatcccattggcctttgaccccacctccataccccgagggatccctctggaagcagcagccgcagcctactacctgccccggcacttggcccccagccccacctacccacacctgtacccgccttacctcatccgcggctaccctgacaccgcggccctggagaaccgccagaccatcatcaatgactacatcacctcgcagcagatgcaccacaacgcagcctctgccatggcccagcgcgccgatatgctgaggggtctgtcaccgagagagtcctcgctggccctcaattatgccgctggcccgcgtggcattatcgacctgtcccaagtgccacacctgcccgtgctggtgccgccaactccaggcacccctgccaccgccatcgaccgccttgcctacctccccactgcgcccccacccttcagcagccgtcacagcagttcaccactgtccccaggaggccccactcacctagctaaaccaactgccacgtcatcatcggagcgggaacgggaacgagagcgagaacgagacaagtccatcctcacgtccaccactacagtggagcatgcacccatctggagacctggtacggagcagagcagcggggctgggggcagcagccgccccgcctcccacacccaccagcactcgcccatctccccccggacccaggacgccttgcagcagaggcccagtgtgctgcacaacacgagcatgaagggcgtggtcacctccgtggaacccggcacgcccacggtcctgaggtccacctccacctcttcacctgtccgcccagctgccacattcccacctgccacccactgcccacttggtggcaccctcgaaggggtctaccctaccctcatggagccagtcctgttacccaaggagacctctcgggttacccggcctgagcggccccgtgtggacgctggccatgccttcctcaccaagcccccagcccgggagcctgcctcctcacccagcaagagctccgaaccccgatccctagcaccccccagctccagccacacagccatcgcccgcaccccagcaaagagccttgcaccccaccatgccagtccggacctgccggcgcccacctcggcctcagatctgcaccgagaaaagactcaaagtaaacccttttccatccaggaattggaactccgttctctgggttaccacagtggagctggctacagccctgatggggtagagcccatcagccccgtgagctcgcccagcctgacccacgacaaggggctctccaagcctctggaagagctagagaagagccacttggagggggagctgcggcacaagcagccaggccccatgaagctcagtggggaggctgcccacctcccacatctgcggccactgccggagagccagccctcatccagcccactcctccagactgccccaggcatcaaaggtcaccagagggtggtcaccttggctcagcacatcagtgaggtcattacacaggactacacacgccaccacccacagcagctcagtggcccccttcccgcccctctctactccttccctggagccagctgccctgtcctggatctccgccgtccacccagtgacctctacctcccacccccggaccatggcaccccagcccggggatccccccacagtgaagggggcaaaaggtctccagaacccagcaaaacagtcctgagtagcagcgaggatgctattgaacctgtgtccccaccggagggcatgactgagccaggacatgcacggagcactgcgtacccactgctgtaccgggacggggagcagggggagcccaggatgggttctaagtctccaggcaacaccagccagccgccagccttcttcagtaagctgaccgagagcaactccgccatggtgaagtcgaagaagcaggagatcaacaagaaactcaacacccataaccggaatgagcctgaatacaatatcggccagcctgggacggaaatcttcaacatgcccgccatcactggagcaggccttatgacctgtagaagccaggcggtgcaagaacacgccagcaccaacatggggctagaggccattattagaaaggcactcatgggtaaatatgatcagtgggaagagcccccgccgctcggcgccaatgcttttaaccctctgaatgccagtgccagtctgcccgctgccgctatgcccataaccactgctgacggacggagtgaccacccactcacctcgccaggtggtggtgggaaagccaaggtttctggcagacccagcagccgaaaagccaagtcgccagcgccaggcctggcacccggagaccgaccaccttctgtctcctcagtacactcggagggcgactgcaatcgccgaacaccactcaccaaccgtgtgtgggaggaccggccctcatctgcagggtccacgccattcccctacaaccctttgattatgaggctacaggcaggtgtcatggcctccccacccccacctggccttgccgcaggcagcgggcccctagctggtccccaccatgcctgggatgaggagcccaagccactgctgtgttcacagtacgagacactctcggacagcgagtgaccacagattgggggggagcggtgccaggtccctgcacgaggcagaagcagcccagcatggagcagacagctgccaactcccccgactgaggaaggagcccctgaatctgcctgcgcgtccatccgtccgtccgtctactcatctgtccatccagagctggcatcctgcctgtctaaagccttaactaagactcccgccccgggctggccctgcgcagtgaccttacactcaggggatgtttacctggtgctcgagaggggagtggacaggaggggaggccagcgggccgggagaggggtacagtgatcgtgtgtcagttgcacgcgtgcatctggggcagcggggacccaacacaggatgaccaggcacctccatgccactgcctcgccccttaccgcatttggaaccaaagtctaagctgagctcgcggccctgcccctccctctgcccccagcccgctcgcgctctggacagacagacgttcccagcttatcctgccccatcgctgtcatcgcagtccccaaaggccacccagcccacaagactgggagcccatcagaccaggtgggtgcacaaagggccgggtatggcctggggcacggatgtttgcaggaaccggaccgttcattcccggcctgtcgctatggcgatggcggggaaggcaggtgtaaatggtgttggcttacagggtatatttttgataccttcaatgagttaattcagtcgcttcacacaaggaaggactcacccgtgttactgccgctgtgctttggtctctgcttcctgtcccagaggcatgtgccggccaaggcggtggccccaccatacgcaggactggggggcaggggctccggcacacggcactgtgccctccccctcccttccttgggcagaatggacttgatgcgtattctgtggccgctctctgcacggcggcattctgtcatttacacatgttgttccaattaaaaggcaaattatactccagttacaaaga

SEQ ID NO: 127 - DNA, 20 bp, Artificial Sequence
  Synthetic oligonucleotide
tgccatgcacacagtaagtg

SEQ ID NO: 128 - DNA, 20 bp, Artificial Sequence
  Synthetic oligonucleotide
tcagaagatgcaggcagtat

SEQ ID NO: 129 - DNA, 20 bp, Artificial Sequence
  Synthetic oligonucleotide
caggccatacccggttctcg

SEQ ID NO: 130 - DNA, 20 bp, Artificial Sequence
  Synthetic oligonucleotide
tgtacagaggctgcagagga

SEQ ID NO: 131 - DNA, 20 bp, Artificial Sequence
  Synthetic oligonucleotide
gacgacactggatcccctag

SEQ ID NO: 132 - DNA, 20 bp, Artificial Sequence
  Synthetic oligonucleotide
gctctgggcaggacaggacc

SEQ ID NO: 133 - DNA, 20 bp, Artificial Sequence
  Synthetic oligonucleotide
ccagctgccccagggagctg

SEQ ID NO: 134 - DNA, 20 bp, Artificial Sequence
  Synthetic oligonucleotide
ccccgtgtctgaggcccagt

SEQ ID NO: 135 - DNA, 20 bp, Artificial Sequence
  Synthetic oligonucleotide
ggtggacctcaggaccgtgg

SEQ ID NO: 136 - DNA, 20 bp, Artificial Sequence
  Synthetic oligonucleotide
tgccaccaagtgggcagtgg

SEQ ID NO: 137 - DNA, 20 bp, Artificial Sequence
  Synthetic oligonucleotide
gtgttcctcaaagactcagg

SEQ ID NO: 138 - DNA, 20 bp, Artificial Sequence
  Synthetic oligonucleotide
gtgttggtactcaagcagcc

SEQ ID NO: 139 - DNA, 20 bp, Artificial Sequence
  Synthetic oligonucleotide
ggctgcccagtggccagcag

SEQ ID NO: 140 - DNA, 20 bp, Artificial Sequence
  Synthetic oligonucleotide
ggctgcggtccttggtaaga

SEQ ID NO: 141 - DNA, 20 bp, Artificial Sequence
  Synthetic oligonucleotide
gctggttgtacagaggcagc

SEQ ID NO: 142 - DNA, 20 bp, Artificial Sequence
  Synthetic oligonucleotide
tccgcatcgcctggtttatt

SEQ ID NO: 143 - DNA, 20 bp, Artificial Sequence
  Synthetic oligonucleotide
gagagcccactgccacgctg

SEQ ID NO: 144 - DNA, 20 bp, Artificial Sequence
  Synthetic oligonucleotide
ggtctttgtacaccttcatg

SEQ ID NO: 145 - DNA, 20 bp, Artificial Sequence
  Synthetic oligonucleotide
agttcttgggatgctgcatg

SEQ ID NO: 146 - DNA, 20 bp, Artificial Sequence
  Synthetic oligonucleotide
gcgatcaggccaaagttctt

SEQ ID NO: 147 - DNA, 20 bp, Artificial Sequence
  Synthetic oligonucleotide
ttgcggcctttggaggccac

SEQ ID NO: 148 - DNA, 20 bp, Artificial Sequence
  Synthetic oligonucleotide
gttggcagttttgcggcctt

SEQ ID NO: 149 - DNA, 20 bp, Artificial Sequence
  Synthetic oligonucleotide
tccaggaggcctttctttgc

SEQ ID NO: 150 - DNA, 20 bp, Artificial Sequence
  Synthetic oligonucleotide
acacagtcttggagcccacc

SEQ ID NO: 151 - DNA, 20 bp, Artificial Sequence
  Synthetic oligonucleotide
ttgtgctgctgaaggatttc

SEQ ID NO: 152 - DNA, 20 bp, Artificial Sequence
  Synthetic oligonucleotide
ggtgggccactggcatcagg

SEQ ID NO: 153 - DNA, 20 bp, Artificial Sequence
  Synthetic oligonucleotide
acattccctgctgggagatg

SEQ ID NO: 154 - DNA, 20 bp, Artificial Sequence
  Synthetic oligonucleotide
gcccagcctgaccccgaggg

SEQ ID NO: 155 - DNA, 20 bp, Artificial Sequence
  Synthetic oligonucleotide
atgacatggcccttgggcag

SEQ ID NO: 156 - DNA, 20 bp, Artificial Sequence
  Synthetic oligonucleotide
tccatcatgtcataggtgcg

SEQ ID NO: 157 - DNA, 20 bp, Artificial Sequence
  Synthetic oligonucleotide
gggatggcacggcccatgag

SEQ ID NO: 158 - DNA, 20 bp, Artificial Sequence
  Synthetic oligonucleotide
atggagcctcggatgtgatg

SEQ ID NO: 159 - DNA, 20 bp, Artificial Sequence
  Synthetic oligonucleotide
atggatagagcggcccgcct

SEQ ID NO: 160 - DNA, 20 bp, Artificial Sequence
  Synthetic oligonucleotide
tccttcagaggccgtggtgc

SEQ ID NO: 161 - DNA, 20 bp, Artificial Sequence
  Synthetic oligonucleotide
aagggtgccccgtggtcctc

SEQ ID NO: 162 - DNA, 20 bp, Artificial Sequence
  Synthetic oligonucleotide
gtcagcttccggtcctggga

SEQ ID NO: 163 - DNA, 20 bp, Artificial Sequence
  Synthetic oligonucleotide
tgtcagggtagccgcggatg

SEQ ID NO: 164 - DNA, 20 bp, Artificial Sequence
  Synthetic oligonucleotide
tagtcattgatgatggtctg

SEQ ID NO: 165 - DNA, 20 bp, Artificial Sequence
  Synthetic oligonucleotide
gcgaggtgatgtagtcattg

SEQ ID NO: 166 - DNA, 20 bp, Artificial Sequence
  Synthetic oligonucleotide
ggtgcatctgctgcgaggtg

SEQ ID NO: 167 - DNA, 20 bp, Artificial Sequence
  Synthetic oligonucleotide
cggtgacagacccctcagca

SEQ ID NO: 168 - DNA, 20 bp, Artificial Sequence
  Synthetic oligonucleotide
ggcacttgggacaggtcgat

SEQ ID NO: 169 - DNA, 20 bp, Artificial Sequence
  Synthetic oligonucleotide
gcaggtgtggcacttgggac

SEQ ID NO: 170 - DNA, 20 bp, Artificial Sequence
  Synthetic oligonucleotide
gttggtttagctaggtgagt

SEQ ID NO: 171 - DNA, 20 bp, Artificial Sequence
  Synthetic oligonucleotide
gaccacgcccttcatgctcg

SEQ ID NO: 172 - DNA, 20 bp, Artificial Sequence
  Synthetic oligonucleotide
acccagagaacggagttcca

SEQ ID NO: 173 - DNA, 20 bp, Artificial Sequence
  Synthetic oligonucleotide
gtggtaacccagagaacgga

SEQ ID NO: 174 - DNA, 20 bp, Artificial Sequence
  Synthetic oligonucleotide
cagtggccgcagatgtggga

SEQ ID NO: 175 - DNA, 20 bp, Artificial Sequence
  Synthetic oligonucleotide
gtaatgacctcactgatgtg

SEQ ID NO: 176 - DNA, 20 bp, Artificial Sequence
  Synthetic oligonucleotide
ttctggagaccttttgcccc

SEQ ID NO: 177 - DNA, 20 bp, Artificial Sequence
  Synthetic oligonucleotide
atgtcctggctcagtcatgc

SEQ ID NO: 178 - DNA, 20 bp, Artificial Sequence
  Synthetic oligonucleotide
ggctggtgttgcctggagac

SEQ ID NO: 179 - DNA, 20 bp, Artificial Sequence
  Synthetic oligonucleotide
accatggcggagttgctctc

SEQ ID NO: 180 - DNA, 20 bp, Artificial Sequence
  Synthetic oligonucleotide
atattgtattcaggctcatt

SEQ ID NO: 181 - DNA, 20 bp, Artificial Sequence
  Synthetic oligonucleotide
acccatgagtgcctttctaa

SEQ ID NO: 182 - DNA, 20 bp, Artificial Sequence
  Synthetic oligonucleotide
agggttaaaagcattggcgc

SEQ ID NO: 183 - DNA, 20 bp, Artificial Sequence
  Synthetic oligonucleotide
tggcgacttggcttttcggc

SEQ ID NO: 184 - DNA, 20 bp, Artificial Sequence
  Synthetic oligonucleotide
tgtgaacacagcagtggctt

SEQ ID NO: 185 - DNA, 20 bp, Artificial Sequence
  Synthetic oligonucleotide
gctctggatggacagatgag

SEQ ID NO: 186 - DNA, 20 bp, Artificial Sequence
  Synthetic oligonucleotide
caggtaaacatcccctgagt

SEQ ID NO: 187 - DNA, 20 bp, Artificial Sequence
  Synthetic oligonucleotide
tagactttggttccaaatgc

SEQ ID NO: 188 - DNA, 20 bp, Artificial Sequence
  Synthetic oligonucleotide
ggcaggataagctgggaacg

SEQ ID NO: 189 - DNA, 20 bp, Artificial Sequence
  Synthetic oligonucleotide
taagccaacaccatttacac

SEQ ID NO: 190 - DNA, 20 bp, Artificial Sequence
  Synthetic oligonucleotide
tcattgaaggtatcaaaaat

SEQ ID NO: 191 - DNA, 20 bp, Artificial Sequence
  Synthetic oligonucleotide
gccgtgtgccggagcccctg

SEQ ID NO: 192 - DNA, 20 bp, Artificial Sequence
  Synthetic oligonucleotide
attctgcccaaggaagggag

SEQ ID NO: 193 - DNA, 20 bp, Artificial Sequence
  Synthetic oligonucleotide
gcggccacagaatacgcatc

SEQ ID NO: 194 - DNA, 20 bp, Artificial Sequence
  Synthetic oligonucleotide
aattggaacaacatgtgtaa

What is claimed is:

1. A method of treating or ameliorating obesity, diabetes, dyslipidemia, hyperthyroidism, or a combination thereof in an animal diagnosed as having obesity, diabetes, dyslipidemia, hyperthyroidism, or a combination thereof, comprising administering to the animal a therapeutically effective amount of a silencing mediator of retinoid and thyroid hormone receptor (SMRT) inhibitor, wherein the SMRT inhibitor is a nucleic acid and the obesity, diabetes, dyslipidemia, hyperthyroidism, or combination thereof is treated or ameliorated in the animal.

2. The method of claim 1, wherein the dyslipidemia is hyperlipidemia.

3. The method of claim 2, wherein the hyperlipidemia is hypercholesterolemia, hypertriglyceridemia, or both hypercholesterolemia and hypertriglyceridemia.

4. The method of claim 1, wherein the administering results in improved insulin sensitivity.

5. The method of claim 1, wherein the administering results in a reduction of triglyceride levels, cholesterol levels, glucose levels, body weight, fat content, insulin resistance, or any combination thereof.

6. A method of decreasing triglyceride levels, cholesterol levels, glucose levels, body weight, fat content, insulin resistance, or any combination thereof in a human comprising administering a silencing mediator of retinoid and thyroid hormone receptor (SMRT) inhibitor to the human diagnosed as being in need of decreasing triglyceride levels, cholesterol levels, glucose levels, body weight, fat content, insulin resistance, or any combination thereof, wherein the SMRT inhibitor is a nucleic acid, thereby decreasing triglyceride levels, cholesterol levels, glucose levels, body weight, fat content, insulin resistance, or any combination thereof in the human.

7. The method of claim 6, wherein the nucleic acid is a modified oligonucleotide.

8. The method of claim 7, wherein the modified oligonucleotide consists of 12 to 30 linked nucleosides.

9. The method of claim 8, wherein said modified oligonucleotide is a single-stranded oligonucleotide.

10. The method of claim 9, wherein the nucleobase sequence of the modified oligonucleotide is 100% complementary to human SMRT.

11. The method of claim 9, wherein at least one internucleoside linkage is a modified internucleoside linkage.

12. The method of claim 11, wherein each internucleoside linkage is a phosphorothioate internucleoside linkage.

13. The method of claim 9, wherein at least one nucleoside contains a modified sugar.

14. The method of claim 13, wherein the modified sugar comprises a 2'-O-methoxyethyl sugar moiety.

15. The method of claim 13, wherein the modified sugar is a bicyclic nucleic acid sugar moiety.

16. The method of claim 9, wherein at least one nucleoside comprises a modified nucleobase.

17. The method of claim 15, wherein the bicyclic nucleic acid sugar moiety comprises a 4'-CH(CH3)-O-2' bridge.

18. The method of claim 1, wherein the administering comprises parenteral administration.

19. The method of claim 18, wherein the parenteral administration comprises subcutaneous or intravenous administration.

20. The method of claim 1, comprising co-administering the SMRT inhibitor and at least one additional therapy.

21. The method of claim 20, wherein the SMRT inhibitor and the additional therapy are administered concomitantly.

22. The method of claim 20, wherein the SMRT inhibitor and the additional therapy are administered in the same formulation.

23. A method comprising identifying an animal having obesity, diabetes, dyslipidemia, hyperthyroidism, or a combination thereof, and administering to said animal a therapeutically effective amount of a composition comprising a modified oligonucleotide consisting of 12 to 30 linked nucleosides having a nucleobase sequence complementary to SEQ ID NO: 1, 2, or 3 as measured over the entirety of said modified oligonucleotide, wherein the modified oligonucleotide is capable of inhibiting silencing mediator of retinoid and thyroid hormone receptor (SMRT), thereby treating the obesity, diabetes, dyslipidemia, hyperthyroidism, or combination thereof.

24. The method of claim 16, wherein the modified nucleobase is a 5-methylcytosine.

25. The method of claim 9, wherein the modified oligonucleotide comprises:
a gap segment consisting of linked deoxynucleotides;
a 5' wing segment consisting of linked nucleosides; and
a 3' wing segment consisting of linked nucleosides;
wherein the gap segment is positioned between the 5' wing segment and the 3' wing segment, and wherein each nucleoside of each wing segment comprises a modified sugar.

26. The method of claim 25, wherein the oligonucleotide comprises:
a gap segment consisting of ten linked deoxynucleosides;
a 5' wing segment consisting of five linked nucleosides; and
a 3' wing segment consisting of five linked nucleosides;
wherein the gap segment is positioned between the 5' wing segment and the 3' wing segment, wherein each nucleoside of each wing segment comprises a 2'-O-methoxyethyl sugar, wherein each internucleoside linkage of said modified oligonucleotide is a phosphorothioate linkage, and wherein each cytosine in said modified oligonucleotide is a 5-methylcytosine.

27. The method of claim 1, wherein the animal is a human.

28. The method of claim 1, wherein the obesity, diabetes, dyslipidemia, hyperthyroidism, or combination thereof is treated.

29. The method of claim 1, wherein the obesity, diabetes, dyslipidemia, hyperthyroidism, or combination thereof is ameliorated.

30. The method of claim 23, wherein the modified oligonucleotide comprises at least one internucleoside linkage that is a modified internucleoside linkage.

31. The method of claim 30, wherein each internucleoside linkage of the modified oligonucleotide is a phosphorothioate internucleoside linkage.

32. The method of claim 23, wherein at least one nucleoside of the modified oligonucleotide comprises a modified sugar.

33. The method of claim 32, wherein the modified sugar comprises a 2'-O-methoxyethyl sugar moiety.

34. The method of claim 32, wherein the modified sugar is a bicyclic nucleic acid sugar moiety.

35. The method of claim 34, wherein the bicyclic nucleic acid sugar moiety comprises a 4'-CH(CH3)-O-2' bridge.

36. The method of claim 23, wherein at least one nucleoside of the modified oligonucleotide comprises a modified nucleobase.

37. The method of claim 1, wherein the nucleic acid comprises a modification selected from the group consisting of a modified internucleoside linkage, a modified sugar moiety, and a modified nucleobase.

* * * * *